United States Patent 11,931,406 (FLAVIVIRUS VACCINE) - sequence listing, part 16

SEQ ID NO: 7980 - RNA, 9879 nt, Artificial Sequence
  derived and/or modified CDS sequence (opt1) from DENV-1__GQ868570__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagguggggaucggcauccuccugacguggcugggccucaacagccgcuccaccagccuguccaugaccugcaucgccguggggauggucacccuguaccucggcgugauggugcaggccgaccuggggugcgucaucaacuggaagggccgggagcugaagugcgggagcggcaucuucgugacgaacgaggugcacaccuggaccgagcaguacaaguuccaggccgacuccccgaagcgccucagcgcggccaucggcaaggccugggaggagggggucugcggcauccggagcgugacccgccuggagaacaucauguggaagcagaucuccaacgagcugaaccacauccuccuggagaacgacaugaaguucaccguggucgugggggacgccaacggcauccuggcccaggggaagaagaugauccggccccagcccauggagcacaaguacagcuggaaguccuggggcaaggcgaagaucaucggcgccgacacgcagaacaccaccuucaucaucgacgggcccgacaccccggagugccccgacggccagcgcgccuggaacaucugggagguggaggacuacggguucggcaucuucacgaccaacaucuggcucaagcugcgggacagcuacacccagaugugcgaccaccgccugauguccgccgcgaucaaggacagcaaggccguccacgccgacaugggcuacuggaucgaguccgagaagaacgagaccuggaagcucgcccgggccagcuucaucgaggugaagacgugcaccuggcccaagucccacacccuguggagcaacggggugcuggaguccgagaugaucauccccaagaucuacggcgggccgaucagccagcacaacuaccgccccggcuacuucacccagacggcggggcccuggcaccucggcaagcuggagcuggacuucgaccucugcgagggcaccaccgucgugguggacgagcacugcgggaaccggggcccgucccugcgcaccacgaccgucaccgggaagaucauccacgaguggugcugccggagcugcacccugccgccccugcgcuuccggggcgaggacgggugcugguacggcauggagauccgccccgugaaggagaaggaggagaaccuggugcgguccauggucagcgccggcuccggggagguggacagcuucagccugggcauccucugcguguccaucaugaucgaggaggucaugcgcagccgguggucccgcaagaugcugaugacggggacccuggccguguuccuccugcugaucaugggccagcucaccuggaacgaccugauccgccugugcaucauggugggggccaacgccagcgaccggaugggcaugggcaccacguaccucgcgcugauggccaccuucaagaugcgcccgauguucgccgucgggcuccucuuccggcgccugaccucccgggaggugcugcuccugaccaucggccugagccucgucgccuccguggagcugcccaacagccuggaggagcucggggacggccuggccaugggcaucaugaugcugaagcuccugacggaguuccagccccaccagcuguggaccacccuccugucccugaccuucgugaagacgacccucagccuggacuacgcguggaagaccaccgccaugguccuguccaucgugagccucuucccccugugccuguccacgaccagccagaagaccaccuggcucccggugcugcugggguccuucggcugcaagccccucaccauguuccugaucacggagaacaagaucugggggcgcaagagcuggccccugaacgagggcaucauggccaucgggaucgucuccauccuccugagcucccugcucaagaacgacgugccccuggccggcccgcugaucgcgggcgggaugcucaucgccugcuacgugaucagcggcagcuccgccgaccugagccuggagaaggccgccgaggucuccugggagcaggaggcggagcacagcggggccucccacaacauccucguggaggugcaggacgacggcaccaugaagaucaaggacgaggagcgggacgacacccugaccauccugcucaaggccacgcugcuggccgucagcgggguguaccccauguccauccccgccacccucuucgugugguacuucuggcagaagaagaagcagcgcagcggcguccugugggacacccccuccccgcccgagguggagcgggcggugcuggacgacggcaucuaccgcauccugcagcgggggcuccugggccgcagccaggucggggugggcguguuccaggacggggucuuccacaccauguggcacgugacgcggggcgccgugcugauguaccagggcaagcgccucgagcccuccugggccagcgucaagaaggaccugaucuccuacgggggcggguggcgguuccagggcagcuggaacaccggggaggagguccaggugaucgccgucgagcccggcaagaacccgaagaacgugcagaccacccccggcacguucaagacccccgagggggaggugggcgccaucgcgcuggacuucaagcccgggaccuccggcagcccgaucgucaaccgcgagggcaagaucguggggcucuacggcaacgggguggucaccacguccggcaccuacgugagcgccaucgcccaggccaaggccucccaggaggggccccugcccgagaucgaggacgagguguucaagaagcggaaccugaccaucauggaccuccacccgggcagcggcaagacccgccgguaccugcccgcgaucguccgcgaggccaucaagcggaagcugcgcacgcucauccuggcccccacccgcgugguggccagcgagauggcggaggcccugaaggggaugcccauccgguaccagaccaccgccgucaaguccgagcacacgggccgcgagaucguggaccucaugugccacgccaccuucaccaugcggcugcugagcccggugcgcguccccaacuacaacaugaucaucauggacgaggcccacuucaccgaccccgcguccaucgccgcccggggguacaucagcacgcgcgugggcaugggggaggccgccgcgaucuucaugaccgccacgccgcccggcuccguggaggccuucccccagagcaacgccgucauccaggacgaggagcgggacauccccgagcgcuccuggaacagcggcuacgacuggaucaccgacuuccccgggaagacggugugguucgugcccuccaucaagagcggcaacgacaucgccaacugccuccggaagaacgggaagcgcgucauccagcugucccggaagaccuucgacaccgaguaccagaagaccaagaacaacgacugggacuacguggugacgaccgacaucagcgagaugggcgcgaacuuccgcgccgaccgggucaucgacccccgccggugccugaagcccgugauccucaaggacgggcccgagcgcgucauccuggccggcccgaugcccgugaccguggccuccgcggcccagcggcgcggccggaucgggcgcaaccagaacaaggagggcgaccaguacgucuacauggggcagccccugaacaacgacgaggaccacgcccacuggaccgaggccaagaugcuccuggacaacaucaacacgcccgagggcaucaucccggcccuguucgagcccgagcgcgagaaguccgcggccaucgacggggaguaccggcuccgcggcgaggcccggaagaccuucguggagcugaugcgccggggcgaccugcccguguggcucuccuacaaggucgccagcgagggguuccaguacuccgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccgcuggcgcugcgggaguucaaggaguucgccgccggccgccgguccgucagcggcgaccucauccuggagaucgggaagcugccccagcaccucacccugcgcgcccagaacgcccuggacaaccucgugaugcugcacaacagcgagcagggcgggaaggcguaccggcacgccauggaggagcugcccgacacgaucgagacccucaugcugcuggcccucaucgccgugcugaccggcggggucacccuguucuuccucuccggcaagggccuggggaagacgagcaucggccugcucugcgugaccgcguccagcgcccugcuguggauggccuccguggagccccacuggaucgccgccagcaucauccucgaguucuuccugaugguccugcucaucccggagcccgacaagcagcgcacgccccaggacaaccagcuggcguacguggugaucgggcuccucuucaugauccuggccgucgccgccaacgagaugggccugcucgagaccacgaagaaggaccuggggaucggcuacguggccaccgagaaccaccagcacgcgaccaugcuggacguggaccuccggccggccuccgccuggacccuguacgccgucgccacgaccgugaucacccccaugaugcgccacaccaucgagaacacgaccgcgaacaucagccugaccgccaucgccaaccaggccgccauccucaugggccuggacaagggguggcccaucuccaagauggacaucggcgugccccugcucgcgcuggggugcuacagccaggucaacccgcugacccucacggccgccgugcugaugcugguggcccacuacgcgaucaucggccccgggcuccaggccaaggccacccgggaggcccagaagcgcaccgccgcgggcaucaugaagaaccccaccgucgacggcaucguggccaucgaccuggaccccguggucuacgacgccaaguucgagaagcagcuggggcagaucaugcuccugauccugugcacgucccagauccuccugaugcgcaccaccugggcccugugcgagagcaucacccucgccacgggcccgcugaccacccugugggaggggucccccggcaaguucuggaacaccacgaucgcggugagcauggccaacaucuuccggggcuccuaccucgccggggccggccuggccuucagccugaugaagucccucgggggcgggcgccggggcaccggcgcgcagggggagacccugggcgagaaguggaagcgccagcugaaccagcucagcaaguccgaguucaacaucuacaagcggagcgggaucauggagguggaccgcagcgaggccaaggagggccugaagcgcggggagaccacgaagcacgccgucucccgcggcaccgccaagcugcggugguucguggagcgcaaccuggugaagcccgagggcaaggucaucgaccucgggugcggccgcggcggguggagcuacuacugcgcggggcugaagaaggugaccgaggugaagggguacaccaagggcgggcccggccacgaggagccgauccccauggccaccuacggguggaaccuggucaagcuccacuccggcaaggacguguucuucaugccgcccgagaagugcgacacgcugcugugcgacaucggggagagcuccccgaaccccaccaucgaggagggccgcacccuccgggugcugaagauggucgagcccuggcugcgcggcaaccaguucugcaucaagauccucaaccccuacaugccgagcgugguggagacccuggagcagaugcagcggaagcacgggggcaugcugguccgcaacccccucucccggaacagcacgcacgagauguacuggguguccugcgggaccggcaacaucgugagcgccgucaacaugaccucccgcaugcugcugaaccgguucaccauggcccaccgcaagcccacguacgagcgcgacguggaccucggcgccgggacccggcacguggcggucgagcccgagguggccaaccuggacaucaucggccagcgcaucgagaacaucaagaacgagcacaagagcaccuggcacuacgacgaggacaacccguacaagaccugggccuaccacggguccuacgaggucaagcccagcggcuccgccagcuccauggugaacggggugguccggcugcucacgaagcccugggacgugauccccauggugacccagaucgccaugaccgacaccacgccguucggccagcagcgcgucuucaaggagaagguggacacccggacgccccgcgcgaagcggggcaccacgcagaucauggaggugaccgccaaguggcuguggggguuccugagccgcaacaagaagccccggaucugcacccgcgaggaguucacccggaagguccgcuccaacgccgccaucggcgccguguucguggacgagaaccaguggaacagcgcgaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggccaagggcagccgggcgaucugguacauguggcucggggcccgcuuccuggaguucgaggcccugggcuucaugaacgaggaccacugguucucccgggagaacagccucuccggggucgagggcgaggggcugcacaagcugggcuacauccuccgcgacaucagcaagaucccgggcgggaacauguacgccgacgacaccgccggcugggacacccggaucaccgaggacgaccugcagaacgaggcgaagaucacggacaucauggagcccgagcacgcccugcucgccaccuccaucuucaagcugaccuaccagaacaagguggugcgcguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuuccugcccuccgagcuggagaccccgaaccucgccgagcgggugcuggacuggcuggagaagcacggcgcggagcgccucaagcggauggccaucagcggggacgacugcgucgugaagcccaucgacgaccgcuucgccgccgcccugacggcgcugaacgacaugggcaaggugcggaaggacaucccccagugggagcccuccaagggcuggaacgacuggcagcaggucccguucugcagccaccacuuccaccagcucaucaugaaggacgggcgcgagaucguggugcccugccggaaccaggacgagcuggucggccgcgcccgggugucccagggggccggcuggagccugcgcgagaccgccugccucgggaaguccuacgcccagauguggcagcugauguacuuccaccggcgcgaccugcggcucgcggccaacgccaucugcagcgccgugcccgucgacugggugcccaccucccgcaccaccuggagcauccacgcgcaccaccaguggaugacgaccgaggacaugcugagcguguggaaccgggucuggaucgaggagaacccguggauggaggacaagacccacguguccagcugggaggaggugcccuaccugggcaagcgcgaggaccaguggugcggcucccucaucgggcugaccgcccgcgccacgugggccaccaacauccaggucgccaucaaccaggugcggcgccugaucggcaacgagaacuaccucgacuacaugaccagcaugaagcgguucaagaacgaguccgaccccgagggggcgcugugguga

SEQ ID NO: 7981 - RNA, 9879 nt, Artificial Sequence
  derived and/or modified CDS sequence (opt1) from DENV-1__KJ189302__SS-prME
agcgugaccaugcugcucaugcugcugcccaccgcgcucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccgcaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccugugguccaacgggguccucgagagcgagaugaucauccccaagaucuacggcgggccgaucucccagcacaacuaccgccccggcuacuucacccagaccgccgggcccuggcaccugggcaagcuggagcucgacuucgaccugugcgagggcacgaccgugguggucgacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgugaaggagaaggaggagaaccugguccggagcaugguguccgccggcagcggggagguggacagcuucucccucggcauccugugcgucagcaucaugaucgaggaggugaugcgcucccgguggagccgcaagaugcugaugaccgggacgcucgccguguuccugcugcucaucaugggccagcugaccuggaacgaccugauccgccucugcaucauggucggggccaacgcguccgaccggaugggcaugggcaccaccuaccuggcccugauggccacguucaagaugcgcccgauguucgccguggggcuccuguuccggcgccugaccagccgggaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgucaagaccacgcugucccuggacuacgccuggaagaccaccgccauggugcucagcaucgugucccuguucccccugugccucagcaccacgucccagaagaccaccuggcugccgguccugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgugccccuggcgggcccgcucaucgccggcgggaugcugaucgccugcuacgucaucagcggcuccagcgccgaccugucccucgagaaggccgcggaggugagcugggagcaggaggccgagcacuccggggccagccacaacauccugguggagguccaggacgacggcacgaugaagaucaaggacgaggagcgggacgacacccugaccauccuccugaaggccacccugcucgccguguccgggguguaccccaugagcauccccgcgacgcuguucgucugguacuucuggcagaagaagaagcagcgcuccggcgugcugugggacacccccagcccgcccgagguggagcgggccguccucgacgacggcaucuaccgcauccugcagcgggggcugcugggccgcucccaggugggggugggcgucuuccaggacgggguguuccacaccauguggcacgugacccggggcgccguccucauguaccagggcaagcgccuggagcccagcugggccuccgugaagaaggaccugaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccucgacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccugcccgagaucgaggacgaggucuucaagaagcggaaccucaccaucauggaccugcacccgggcagcggcaagacccgccgguaccugcccgccaucgugcgcgaggccaucaagcggaagcuccgcacccugauccuggcccccacgcgcguggucgcguccgagauggccgaggcccucaaggggaugcccauccgguaccagaccaccgccgucaagagcgagcacaccggccgcgagaucguggaccugaugugccacgccacguucaccaugcggcugcucuccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccccgccggugccucaagcccgugauccugaaggacgggcccgagcgcgucauccuggccggcccgaugcccgugaccgucgcgagcgccgcccagcggcgcggccggaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucguggagcugaugcgccggggcgaccuccccgucuggcugagcuacaagguggccuccgagggguuccaguacagcgaccgccgguggugcuucgacggcgagcgcaacaaccaggugcuggaggagaacauggacgucgagaucuggaccaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggugaugcugcacaacuccgagcagggcgggaaggccuaccggcacgccauggaggagcuccccgacaccaucgagacgcugaugcugcucgcccugaucgcgguccugaccggcggggugacccucuucuuccugagcggcaagggccuggggaagaccuccaucggccuccugugcgugacggccagcuccgcccugcucuggauggccagcgucgagccccacuggaucgccgcguccaucauccuggaguucuuccugauggugcuccugaucccggagcccgaccgccagcggacgccccaggacaaccagcuggccuacguggucaucgggcuccuguucaugauccugaccguggccgccaacgagaugggccuccuggagaccacgaagaaggaccuggggaucggcuacguggccgcggagaaccaccagcacgccaccaugcucgacgucgaccugcgcccggccagcgccuggacccuguacgccguggcgaccacggugaucacccccaugaugcggcacaccaucgagaacaccacggccaacaucucccucaccgccaucgccaaccaggccgcgauccugaugggccuggacaagggguggcccaucagcaagauggacaucggcgucccccuccuggcccuggggugcuacucccaggugaacccgcucacccugaccgccgccgugcugaugcucgucgcgcacuacgccaucaucggccccgggcugcaggccaaggccacgcgcgaggcccagaagcgcaccgcggccggcaucaugaagaaccccaccguggacggcaucguggccaucgaccuggaccccgucguguacgacgccaaguucgagaagcagcucgggcagaucaugcugcugauccucugcaccagccagauccugcugaugcggacgaccugggcccucugcgaguccaucacccuggcgaccggcccgcugacgacccucugggaggggagccccggcaaguucuggaacaccaccaucgccguguccauggccaacaucuuccgcggcagcuaccuggccggggccggccuggcguucucccucaugaagucccucgggggcgggcggcgcggcacgggcgcccagggggagacccugggcgagaaguggaagcggcagcucaaccagcuguccaagagcgaguucaacaccuacaagcgcagcgggaucauggaggucgaccgguccgaggccaaggagggccugaagcgcggggagaccacgaagcacgccgugagccggggcaccgcgaagcuccgcugguucguggagcggaaccuggucaagcccgagggcaaggugaucgaccuggggugcggccgcgggggcugguccuacuacugcgccgggcugaagaaggugaccgaggucaagggcuacaccaagggcgggcccggccacgaggagccgauccccauggccaccuacggguggaaccucgugaagcugcacagcggcaaggacguguucuucaugccgcccgagaagugcgacacgcugcucugcgacaucggggaguccagcccgucccccaccaucgaggagggccggacccugcgcguccugaagaugguggagcccuggcuccggggcaaccaguucugcaucaagauccugaaccccuacaugccgagcguggucgagacccuggagcagaugcagcgcaagcacgggggcaugcucgugcggaacccccugucccgcaacagcacgcacgagauguacuggguguccugcgggaccggcaacaucgucagcgccgugaacaugaccucccggaugcugcucaaccgcuucaccauggcccaccgcaagcccacguacgagcgggacguggaccugggcgcggggacccgccacgucgccguggagcccgagguggccaaccuggacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggucgugcgccuccugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgccaaguggcuguggggguuccucagccggaacaagaagccccgcaucugcacccgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggcgaagggcagccgcgccaucugguacauguggcugggggcccgguuccuggaguucgaggcccucggcuucaugaacgaggaccacugguucucccgcgagaacagccuguccgggguggagggcgaggggcugcacaagcucggcuacauccugcgggacaucagcaagaucccgggcgggaacauguacgccgacgacaccgcgggcugggacacccgcaucaccgaggacgaccugcagaacgaggccaagaucacggacaucauggagcccgagcacgcccuccuggccaccuccaucuucaagcugaccuaccagaacaaggugguccgcgugcagcggcccgccaagaacgggaccgugauggacgucaucagccgccgggaccagcgcggcuccggccagguggggacguacggccucaacaccuucaccaacauggaggugcagcugauccggcagauggagagcgaggggaucuuccugcccuccgagcucgagaccccgaaccuggcggagcgcguccuggacuggcucgagaagcacggcgccgagcggcugaagcgcauggccaucagcggggacgacugcguggugaagcccaucgacgaccgguucgccacggcccugaccgcgcucaacgacaugggcaagguccgcaaggacaucccccagugggagcccuccaagggcuggaacgacuggcagcaggucccguucugcagccaccacuuccaccagcugaucaugaaggacgggcgggagaucgugguccccugccgcaaccaggacgagcuggugggccgggcccgcgugucccagggggccggcuggagccuccgggagaccgccugccuggggaaguccuacgcccagauguggcagcugauguacuuccaccgccgggaccuccgccuggcggccaacgccaucugcagcgccguccccguggacugggugcccaccagccggaccacgugguccauccacgcgcaccaccaguggaugaccaccgaggacaugcugagcgucuggaaccgcguguggaucgaggagaacccguggauggaggacaagacccacguguccagcugggaggagguccccuaccucggcaagcgcgaggaccaguggugcggcucccugaucgggcugacggcccgggccaccugggccaccaacauccagguggccaucaaccaggugcgccggcucaucggcaacgagaacuaccuggacuacaugaccagcaugaagcgcuucaagaacgaguccgaccccgagggggcgcugugguga

SEQ ID NO: 7982 - RNA, 9879 nt, Artificial Sequence
  derived and/or modified CDS sequence (opt1) from DENV-1__KJ189303__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgugaucggcaccagcaucacccagaaggggaucaucuucauccugcugaugcucgucacccccuccauggccaugcggugcgugggcaucggcaaccgcgacuucguggaggggcugagcggcgccacgugggucgacguggugcuggagcacggguccugcgucaccaccauggccaagaacaagcccacccucgacaucgagcugcugaagacggaggugaccaaccccgccgugcuccggaagcugugcaucgaggcgaagaucagcaacaccaccacggacucccgcugcccgacccagggcgaggccacccuggucgaggagcaggacgccaacuucgugugccggcgcaccuucguggaccggggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccgcaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcucaucacggccaacccgaucgugaccgacaaggagaagcccgugaacaucgagaccgagccgcccuucggggagagcuacaucgucgugggcgccggcgagaaggcccugaagcuguccugguucaagaaggggagcuccaucggcaagauguucgaggcgaccgcccgcggggcccggcgcauggccauccucggcgacacggccugggacuucgggagcaucggcggcguguucaccuccgucgggaagcuggugcaccagguguucggcaccgcguacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccuggcccaggggaagaagaugauccggccccagcccauggagcacaaguacuccuggaaguccuggggcaaggcgaagaucaucggcgccgacacgcagaacaccaccuucaucaucgacgggcccgacaccccggagugccccgacggccagcgcgccuggaacaucugggagguggaggacuacggguucggcaucuucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagacgugcaccuggcccaagagccacacccucugguccaacggggugcuggagagcgagaugaucauccccaagaucuacggcgggccgaucucccagcacaacuaccgccccggcuacuucacccagacggcggggcccuggcaccugggcaagcucgagcuggacuucgaccugugcgagggcaccaccguggucguggacgagcacugcgggaaccggggcccgagccuccgcaccacgaccgugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugacggggacccuggccgucuuccugcuccugaucaugggccagcugaccuggaacgaccucacccgccugugcaucauggugggggccaacgccuccgaccggaugggcaugggcacgaccuaccuggcgcucauggccaccuucaagaugcgcccgauguucgccguggggcugcuguuccggcgccucaccagccgggagguccugcugcucacgaucgggcugucccugguggccagcgucgagcuccccaacucccuggaggagcugggggacggccucgccaugggcaucaugaugcugaagcugcucaccgaguuccagccccaccagcuguggaccacccugcucagccugacguucgugaagaccacccugucccucgacuacgcguggaagaccacggccauggugcugagcaucgucucccuguucccccucugccugagcaccaccucccagaagaccaccuggcugccggugcuccuggggagcuucggcugcaagccccugacgauguuccucaucaccgagaacaagaucugggggcgcaaguccuggccccugaacgagggcaucauggccaucgggaucgugagcauccugcucuccagccugcugaagaacgacgucccccucgccggcccgcugaucgcgggcgggaugcugaucgccugcuacgugaucagcggcuccagcgccgaccucucccuggagaaggccgccgaggugagcugggagcaggaggcggagcacuccggggccagccacaacauccuggucgaggugcaggacgacggcaccaugaagaucaaggacgaggagcgggacgacacccucacgauccugcugaaggccacccuccuggccguguccggggucuaccccaugagcauccccgccacccuguucgugugguacuucuggcagaagaagaagcagcgcuccggcgugcucugggacacccccagcccgcccgaggucgagcgggcggugcuggacgacggcaucuaccgcauccugcagcgggggcugcucggccgcucccaggugggggucggcguguuccaggacgggguguuccacacgauguggcacgucacccggggcgccgugcugauguaccagggcaagcgccuggagcccagcugggccuccgugaagaaggaccucaucagcuacgggggcggguggcgguuccagggcuccuggaacaccggggaggagguccaggugaucgccguggagcccggcaagaacccgaagaacguccagaccacgcccggcaccuucaagacccccgagggggaggugggcgccaucgcgcuggacuucaagcccgggaccagcggcuccccgaucgugaaccgcgagggcaagaucgucgggcuguacggcaacgggguggugacgaccagcggcaccuacgucuccgccaucgcccaggccaaggccagccaggaggggccccuccccgagaucgaggacgagguguucaagaagcggaaccugaccaucauggaccugcacccgggcagcggcaagacgcgccgguaccuccccgcgaucgugcgcgaggccaucaagcggaagcugcgcacccugauccucgcccccacccgcgucguggccuccgagauggcggaggcccugaaggggaugcccauccgguaccagaccacggccgucaagagcgagcacaccggccgcgagaucgucgaccugaugugccacgccaccuucaccaugcggcuccuguccccggugcgcgugcccaacuacaacaugaucaucauggacgaggcccacuucacggaccccgcgagcaucgccgcccggggguacaucuccacccgcgucggcaugggggaggccgccgcgaucuucaugaccgccacgccgcccggcagcguggaggccuucccccaguccaacgccgugauccaggacgaggagcgggacauccccgagcgcagcuggaacuccggcuacgacuggaucacggacuuccccgggaagaccgucugguucgugcccagcaucaaguccggcaacgacaucgccaacugccugcggaagaacgggaagcgcgugauccagcucagccggaagaccuucgacaccgaguaccagaagacgaagaacaacgacugggacuacgucgugaccaccgacaucuccgagaugggcgcgaacuuccgcgccgaccgggugaucgacccccgccggugccugaagcccgucauccugaaggacgggcccgagcgcgugauccucgccggcccgaugcccgucaccguggccagcgcggcccagcggcgcggccggaucgggcgcaaccagaacaaggagggcgaccaguacguguacauggggcagccccugaacaacgacgaggaccacgcccacuggacggaggccaagaugcugcucgacaacaucaacacccccgagggcaucaucccggcccuguucgagcccgagcgcgagaaguccgcggccgucgacggggaguaccggcugcgcggcgaggcccggaagaccuucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccgcucgcgcugcgggaguucaaggaguucgccgccggccgccggagcgucagcggcgaccugauccucgagaucgggaagcugccccagcaccugacgcuccgcgcccagaacgcccuggacaaccuggugaugcuccacaacuccgagcagggcgggaaggcguaccggcacgccauggaggagcugcccgacaccaucgagacccugaugcuccuggcccugaucgccgugcucaccggcggggucacgcuguucuuccugagcggcaagggccucgggaagaccuccaucggccugcugugcgugaccgcgagcuccgcccuccuguggauggccagcguggagccccacuggaucgccgccuccaucauccuggaguucuuccucaugguccugcugaucccggagcccgaccgccagcggacgccccaggacaaccagcucgcguacguggugaucgggcugcuguucaugauccucacggucgccgccaacgagaugggccugcuggagaccaccaagaaggaccucgggaucggcuacguggccgccgagaaccaccagcacgcgaccaugcuggacguggaccugcgcccggccagcgccuggacgcucuacgccgucgccaccaccgugaucacccccaugaugcggcacacgaucgagaacaccaccgcgaacaucucccugaccgccaucgccaaccaggccgccauccugaugggccucgacaagggguggcccaucagcaagauggacaucggcgugccccugcuggcgcucgggugcuacucccaggucaacccgcugacgcugaccgccgccgugcucaugcugguggcccacuacgcgaucaucggccccgggcugcaggccaaggccacccgcgaggcccagaagcgcaccgccgcgggcaucaugaagaaccccacggucgacggcaucguggccaucgaccucgaccccguggucuacgacgccaaguucgagaagcagcuggggcagaucaugcugcucauccugugcaccagccagauccugcucaugcggaccaccugggcccugugcgaguccaucacgcuggccaccggcccgcucaccacccugugggaggggagccccggcaaguucuggaacacgaccaucgcgguguccauggccaacaucuuccgcggcagcuaccuggccggggccggccucgccuucucccugaugaagucccucgggggcgggcggcgcgggaccggcgcgcagggggagacccucggcgagaaguggaagcggcagcugaaccagcuguccaagagcgaguucaacacguacaagcgcagcgggaucauggagguggaccgguccgaggccaaggagggccucaagcgcggggagaccaccaagcacgccgucagccggggcaccgccaagcugcgcugguucguggagcggaaccuggugaagcccgagggcaaggucaucgaccuggggugcggccgcgggggcugguccuacuacugcgcggggcucaagaaggugaccgaggugaagggcuacacgaagggcgggcccggccacgaggagccgauccccauggccaccuacggguggaaccuggucaagcugcacagcggcaaggacguguucuucaugccgcccgagaagugcgacacccuccugugcgacaucggggaguccagcccgaaccccaccaucgaggagggccggacgcugcgcgugcucaagauggucgagcccuggcugcggggcaaccaguucugcaucaagauccugaaccccuacaugccguccgugguggagacccucgagcagaugcagcgcaagcacgggggcaugcugguccggaacccccugagccgcaacuccacccacgagauguacugggugagcugcgggaccggcaacaucguguccgccgucaacaugacgagccggaugcuccugaaccgcuucaccauggcccaccgcaagcccaccuacgagcgggacguggaccugggcgccgggacccgccacguggcggucgagcccgagguggccaaccucgacaucaucggccagcggaucgagaacaucaagaacgagcacaaguccacguggcacuacgacgaggacaacccguacaagaccugggccuaccacgggagcuacgaggucaagcccuccggcagcgccuccagcauggugaacggggugguccgccugcugaccaagcccugggacgugauccccauggugacccagaucgccaugacggacaccaccccguucggccagcagcgggucuucaaggagaagguggacacccgcacgccccgggcgaagcgcggcaccacccagaucauggaggugaccgccaaguggcucuggggguuccugucccggaacaagaagccccgcaucugcacgcgggaggaguucacccgcaagguccggagcaacgccgccaucggcgccguguucguggacgagaaccaguggaacagcgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaagggcucccgcgcgaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgccggcugggacacgcgcaucaccgaggacgaccuccagaacgaggcgaagaucaccgacaucauggagcccgagcacgcccugcuggccaccagcaucuucaagcucacguaccagaacaagguggugcgcguccagcggcccgccaagaacgggaccgugauggacgugaucucccgccgggaccagcgcggcagcggccaggucgggaccuacggccugaacaccuucacgaacauggaggugcagcugauccggcagauggaguccgaggggaucuuccuccccagcgagcuggagaccccgaaccuggccgagcgcgugcucgacuggcuggagaagcacggcgcggagcggcugaagcgcauggccaucuccggggacgacugcgucgugaagcccaucgacgaccgguucgccaccgcccucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcucgucggccgggcgcgcgugagccagggggccggcuggucccugcgggagaccgccugccugggcaagagcuacgcccagauguggcagcucauguacuuccaccgccgggaccugcgccuggccgcgaacgccaucugcuccgccgugcccgucgagugggugcccacgagccggaccaccuggagcauccacgcccaccaccaguggaugaccacggaggacaugcucuccguguggaaccgcgucuggaucgaggagaacccguggauggaggacaagacccacgugagcuccugggaggaggugcccuaccugggcaagcgcgaggaccaguggugcggcagccugaucgggcucaccgcgcgggccaccugggccacgaacauccaggucgccaucaaccaggugcgccggcugaucggcaacgagaacuaccuggacuacaugaccuccaugaagcgcuucaagaacgagagcgaccccgagggggcccucugguga

SEQ ID NO: 7983 - RNA, 9879 nt, Artificial Sequence
  derived and/or modified CDS sequence (opt1) from DENV-1__KR028435__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaucugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccaucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgguaccucccggccaucguccgcgaggccaucaagcggaagcugcgcacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagggcgggaucuccgagcgcagcuggaacuccggcuacgaguggaucaccgacuuccccgggaagaccgugugguucgugcccagcaucaaguccggcaacgacaucgccaacugccugcggaagaacgggaagcgcgucauccagcucagccggaagaccuucgacacggaguaccagaagaccaagaacaacgacugggacuacguggugaccaccgacaucuccgagaugggcgcgaacuuccgcgccgaccgggucaucgacccccgccggugccugaagccggugauccugaaggacgggcccgagcgcgugauccucgccggccccaugcccgucacgguggccagcgccgcgcagcggcgcggccggaucgggcgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagaccuucgucgagcucaugcgccggggcgaccugccgguguggcugagcuacaagguggccagcgagggguuccaguacuccgaccgccgguggugcuucgacggcgagcgcaacaaccagguccucgaggagaacauggacguggagaucuggacgaaggagggggagcggaagaagcugcgcccccgguggcuggacgcccgcaccuacagcgacccccucgcccugcgggaguucaaggaguucgcggccggccgccgguccgugagcggcgaccugauccucgagaucgggaagcugccccagcaccugacccagcgcgcccagaacgcccucgacaaccuggucaugcugcacaacuccgagcagggcgggcgggcguaccgccacgccauggaggagcucccggacaccaucgagacgcugaugcugcucgcccugaucgccgugcugaccggcggggugacccucuucuuccugagcggccggggccuggggaagaccuccaucggccuccugugcgucauggccagcuccgugcugcucuggauggcgagcguggagccccacuggaucgccgccuccaucauccuggaguucuuccugaugguccuccugauccccgagcccgaccgccagcggaccccgcaggacaaccagcuggccuacguggugaucgggcuccuguucaugauccugacggucgccgcgaacgagaugggccuccuggagaccaccaagaaggaccuggggaucggccacguggccguggagaaccaccaccacgccaccaugcucgacgucgaccugcaccccgccagcgccuggacgcuguacgcgguggccaccaccaucaucacccccaugaugcgccacacgaucgagaacaccaccgccaacaucucccucaccgccaucgccaaccaggcggccauccugaugggccuggacaagggguggccgaucagcaagauggacaucggcgugccccuccuggcccuggggugcuacucccaggucaacccccucacgcugaccgccgcggugcugaugcucguggcccacuacgccaucaucggccccgggcugcaggccaaggccacccgggaggcgcagaagcgcaccgccgccggcaucaugaagaacccgacggucgacggcaucguggccaucgaccuggaccccguggucuacgacgccaaguucgagaagcagcucgggcagaucaugcugcugauccucugcaccagccagauccugcugaugcgcaccaccugggcgcucugcgaguccaucacgcuggccaccggcccccugaccacccucugggaggggagccccggcaaguucuggaacacgaccaucgccguguccauggccaacaucuuccggggcagcuaccuggccggggcgggccuggccuucagccucaugaagucccucgggggcgggcgccggggcaccggcgcccagggggagacccugggcgagaaguggaagcgccagcucaaccagcugagcaaguccgaguucaacacguacaagcggagcgggaucauggagguggaccgcuccgaggccaaggagggccugaagcgcggggagaccaccaagcacgcggucagccgcggcaccgccaagcuccggugguucguggagcgcaaccuggugaagccggagggcaaggucaucgaccuggggugcggccgcgggggcugguccuacuacugcgccgggcugaagaaggugacggaggugaagggcuacaccaagggcgggcccggccacgaggagcccauccccauggccaccuacggguggaaccucgucaagcuguacagcggcaaggacguguucuucaucccgcccgagaagugcgacacccugcucugcgacaucggggaguccagccccaaccccacgaucgaggagggccgcacccugcgggugcugaagauggucgagccguggcuccgcggcaaccaguucugcaucaagauccugaaccccuacaugcccuccgugguggagacccuggagcagaugcagcggaagcacgggggcaugcucguccgcaacccccugagccggaacuccacccacgagauguacugggugagcugcgggaccggcaacaucguguccgccgucaacaugacgagccgcaugcugcucaaccgguucaccauggcgcaccgcaagccgaccuacgagcgcgacguggaccugggcgccgggacccggcacguggccgucgagcccgagguggccaaccuggacaucaucggccagcgcaucgagaacaucaagcacgagcacaaguccacguggcacuacgacgaggacaaccccuacaagaccugggccuaccacgggagcuacgaggugaagcccuccggcagcgcgagcuccauggucaacgggguggucaagcuccugaccaagccgugggacgugauccccauggugacccagaucgccaugacggacaccacccccuucggccagcagcgggucuucaaggagaagguggacacccgcacgcccaaggccaagcggggcaccgcccagaucauggaggugaccgcccgcuggcuguggggguuccucagccggaacaagaagccgcgcaucugcacccgggaggaguucacgcgcaagguccgguccaacgcggccaucggcgccguguucaucgacgagaaccaguggaacagcgccaaggaggcgguggaggacgagcgcuucugggaccugguccaccgggagcgcgagcugcacaagcaggggaagugcgcgaccugcguguacaacaugaugggcaagcgggagaagaagcucggggaguucggcaaggccaagggcucccgcgccaucugguacauguggcugggggcccgguuccuggaguucgaggcgcucggcuucaugaacgaggaccacugguucagccgcgagaacucccugagcgggguggagggcgaggggcugcacaagcucggcuacauccugcgggacaucuccaagauccccggcgggaacauguacgccgacgacaccgccggcugggacacccgcaucacggaggacgaccugcagaacgaggccaagaucaccgacaucauggagcccgagcacgcccuccuggcgaaggccaucuucaagcugaccuaccagaacaaggucgugcgggugcagcgcccggccaagaacgggaccgucauggacgugaucagccgccgggaccagcgcggcuccggccagguggggacguacggccucaacaccuucaccaacauggaggcccagcugauccggcagauggagagcgaggggaucuucucccccagcgagcuggagacccccaaccucgccgagcgcguccuggacuggcuggagaaguacggcguggagcggcucaagcgcauggcgaucuccggggacgacugcguggucaagcccaucgacgaccgguucgccacggcccugaccgcccugaacgacaugggcaaggugcgcaaggacaucccgcagugggagcccagcaagggcuggaacgacuggcagcagguccccuucugcucccaccacuuccaccagcucaucaugaaggacgggcgggagaucgucgugcccugccgcaaccaggacgagcuggugggccgggcccgcgucagccagggggcgggcuggagccugcgggagaccgccugccucgggaaguccuacgcccagauguggcagcugauguacuuccaccgccgggaccugcgccucgccgcgaacgccaucugcagcgccgugccgguggacuggguccccaccucccggacgaccuggagcauccacgcccaccaccaguggaugaccaccgaggacaugcuguccguguggaaccgcguguggaucgaggagaaccccuggauggaggacaagacgcacaucagcuccugggaggacguccccuaccugggcaagcgggaggaccaguggugcggcagccucaucgggcugaccgcccgcgcgaccugggccaccaacauccagguggccaucaaccaggugcgccggcugaucggcaacgagaacuaccucgacuacaugaccuccaugaagcgcuucaagaacgagagcgacccggagggggcccugugguga

SEQ ID NO: 7984 - RNA, 9879 nt, Artificial Sequence
  derived and/or modified CDS sequence (opt1) from DENV-1__JQ922548__SS-prME
agcgugaccaugcugcucaugcugcugcccaccgcccucgccuuccaccugaccacccggggcggggagccgcacaugaucgugagcaagcaggagcggggcaagagccuccuguucaagaccagcgccggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggcggcagauccagaaggucgagaccugggcccugcgccacccgggguucacggugaucgcccuguuccucgcgcacaccaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggcccggaacaagcccacgcucgacaucgagcugcugaagaccgaggucaccaaccccgccgugcuccgcaagcugugcaucgaggcgaagaucagcaacaccacgaccgacucccggugcccgacccagggcgaggccacccugguggaggagcaggacgccaacuucgucugccgccggacguucguggaccgcggcugggggaacggcugcggccuguucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgccaccaucacgccccaggcgcccaugagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccaggccaagaagcaggaggucguggugcugggcucccaggagggcgcgaugcacaccgcccucaccggggccacggagauccagaccagcggcaccaccacgauguucgccgggcaccugaagugccggcugaagauggacaagcucacccugaagggcgccuccuacgucaugugcaccgggcccuucaagcuggagaaggagguggcggagacccagcacggcacggugcugguccaggugaaguacgagggcaccgacgcccccugcaagaucccguucagcacccaggacgagaagggggugacccagaacggccgccucaucacggccaaccccaucgucaccgacaaggagaagcccgugaacaucgagaccgagcccccguucggggaguccuacaucgugaucggcgccggcgagaaggcgcugaagcugagcugguucaagaagggguccagcaucggcaagauguucgaggccaccgcccgcggggcccgccgcauggccauccucggcgacacggcgugggacuucggguccaucggcggcgccuucaccagcgucgggaagcuggugcaccagguguucggcaccgccuacgggguccuguucuccggcgugagcuggaccaugaagaucgggaucggcauccuccugacguggcugggccucaacucccggagcaccucccugagcaugaccugcaucgccguggggauggucacccuguaccucggcgugauggugcaggccgacuccgggugcgucaucaacuggaagggccgcgagcugaagugcgggagcggcaucuucgugacgaacgaggugcacaccuggaccgagcaguacaaguuccaggcggacucccccaagcggcugagcgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacgcgaacggcauccugacgcaggggaagaagaugauccgcccccagcccauggagcacaaguacagcuggaaguccuggggcaaggccaagaucaucggcgccgacgcccagaacaccaccuucaucaucgacgggccggacacccccgagugccccgacgaccagcgggcguggaacaucugggagguggaggacuacggcuucgggaucuucacgaccaacaucuggcugaagcuccgcgacagcuacacccagaugugcgaccaccggcugauguccgccgccaucaaggacagcaaggccgugcacgccgacaugggcuacuggaucgaguccgagaagaacgagaccuggaagcugacgcgcgcgagcuucaucgaggucaagaccugcaccuggccccggucccacacccucuggagcaacggcgugcuggaguccgagaugaucaucccgaagaucuacgggggccccaucagccagcacaacuaccgccccggguacuucacgcagaccgccggcccguggcaccuggggaagcucgagcuggacuucaaccugugcgagggcaccaccguggucguggacgagcacugcggcaacgggggcgccucccucgggacgaccaccgugaccggcaagaucauccacgaguggugcugccggagcugcacgcugccgccccugcgcuuccucggggaggacggcugcugguacggcauggagauccggcccgucaaggagaaggaggagaaccuguuccgcuccauggugagcgccggguccggcgagguggacagcuucagccuggggcuccugugcgucuccaucaugaucgaggaggugaugcggagccgcuggucccggaagaugcugaugaccggcacccucgccguguucuuccugcugaucauggggcagcucaccuggaacgaccugauccgccugugcaucauggucggcgcgaacgccagcgaccgcaucggcauggggacgaccuaccucgcccugauggccaccuucaagaugcggccgauguucgccgugggccuccucuuccgccggcugaccucccgcgaggugcugcuccugacgaucgggcugagccucgucgcguccguggagcugcccaacagccuggaggagcucggcgacggccuggccauggggaucaugaugcugaagcuccugaccgacuuccagucccaccagcuguggaccacccuccugagccugacguucaucaagaccacccucucccuggacuacgccuggaagaccaucgccauggugcugagcaucgucucccucuucccccugugccugagcacgaccucccagaagaccaccuggcuccccgugcugcugggcagcuucggguccaagccgcucaccauguuccugaucacggagaacaagaucuggggccgcaagagcuggccccugaacgaggggaucauggcggucggcaucguguccauccuccugagcagccugcccaagaacgacgugccccucgccggcccgcugaucgccgggggcaugcugaucgccugcuacgucaucuccgggagcuccgccgaccucagccuggagcgcgcggccgagguguccugggaggaggaggccgagcacagcggcgccucccacaacauccugguggagguccaggacgacgggaacaugaagaucaaggacgaggagcgggacgacagccucaccauccugcugaaggccacccuccuggcgguguccggcguguaccccaugagcauccccgccacccuguucgucugguacuucuggcagaagaagaagcagcgcuccggcgugcucugggacacgcccagcccgcccgaggugguccgggccgugcuggacgacgggaucuaccgcauccugcagcggggccugcucgggcgcucccaggugggcgucgggguguuccaggacggcguguuccacaccauguggcacgucacccggggcgccgugcugauguaccaggggaagcgccuggagcccagcugggccuccgugaagaaggaccucaucagcuacggcgggggcuggcgguuccagggguccuggaacaccggcgaggagguccaggugaucgcgguggagcccggcaagaacccgaagaacguccagacgacccccgggaccuucaagacccccgagggcgaggugggggccaucgcccuggacuucaagcccggcacgagcggcuccccgaucgugaaccgcgaggggaagaucgucggccuguacgggaacggcguggugaccaccagcgggaccuacgucagcgccaucgcccaggcgaaggccucccaggagggcccccuccccgagaucgaggacgagguguucaagaagcggaaccugacgaucauggaccugcacccgggcagcgggaagacccgccgguaccuccccgccaucgugcgcgaggccaucaagcggaagcugcgcacccugauccucgcgcccacccgcgucguggccuccgagauggccgaggcccugaagggcaugcccauccgguaccagacgaccgccgucaagagcgagcacaccgggcgcgagaucgucgaccugaugugccacgcgaacuucaccaugcggcuccuguccccggugcgcgugcccaacuacaacaugaucaucauggacgaggcccacuucacggaccccgccagcaucgccgcccggggcuacaucuccacccgcgucgggaugggcgaggcggccgccaucuucaugaccgccacgccgcccggcagcguggaggccuucccccaguccaacgcggugauccaggacgaggagcgggacauccccgagcgcagcuggaacuccggguacgacuggaucacggacuuccccggcaagaccgucugguucgugcccagcaucaaguccgggaacgacaucgccaacugccugcggaagaacggcaagcgcgugauccagcucagccggaagaccuucgacaccgaguaccagaagacgaagaacaacgacugggacuacgucgugaccaccgacaucuccgagaugggggccaacagccgcaccgaccgggugaucgacccccgccggugccugaagcccgucauccugaaggacggccccgagcgcgugauccucgccggcccgaugcccgugacggcggccuccgccgcccagcggcgcgggcggaucggccgcaaccagaacaaggagggggaccaguacaucuacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccggcugcgcggcgaggcccggaagaccuucgucgagcucaugcgccgcggggaccugcccguguggcuguccuacaaggucgcgagcgagggcuuccaguacagcgaccgccgguggugcuucgacggggagcgcaacaaccaggugcucgaggagaacauggacguggagaucuggacgaaggagggcgagcggaagaagcugcgcccccgguggcuggacgcccgcaccuacuccgacccgcucgcccugcgggaguucaaggaguucgccgccggccgccggagcgucuccggggaccugauccucgagaucggcaagcugccccagcaccugacccuccgcgcgcagaacgcccuggacaaccuggugaugcuccacaacagcgagcagggcgggaaggccuaccggcacgccauggaggagcugcccgacaccaucgagacccugaugcuccuggcgcugaucgccgugcucaccggcggggucacccuguucuuccuguccgggaaggggcucggcaagaccagcaucgggcugcugugcgugauggccuccagcgugcuccuguggauggccuccgucgagccccacuggaucgccgcgagcaucauccuggaguucuuccucaaggagcugcugaucccggacgccgacggccagcgcacgccccaggacaaccagcucgccuacguggugaucgggcugcuguucaugauccucacggucgccgccaacgagaugggccugcuggagaccaccaagaagaaccucggcaucgggcacgugguggcggagaaccaccaccacgccaccaugcuggacaucgaccugcaccccgccuccgccuggacgcucuacgccgucgcgaccaccaucaucaccccgaugaugcggcacacgaucgagaacaccaccgccaacaucagccugaccgccaucgccaaccaggccgcgauccugaugggccucgacaaggggcgccccaucuccaagauggacaucggcgugccccugcuggcccucgggugcuacagccaggugaacccccugacgcugaccgccgccguccucaugcugguggcgcacuacgccaucaucggcccgggccugcaggccaaggccacccgggaggcccagaagcgcaccgcggccgggcucaugaagaaccccacgguggacggcaucgccgccaucgaccuggaccccgucguguacgacgccaaguucgagaagcagcuggggcagaucaugcuccugauccugugcaccucccagauccuccugaugcgcaccaccugggcgcugugcgagagcaucacgcucgccaccggcccccugaccacccugugggagggcuccccggggaaguucuggaacacgaccaucgccgugagcauggccaacaucuuccggggcuccuaccucgccggggcgggccuggccuucagccugaugaagucccucgggggcggccgccgggggaccggcgcccagggggagacccugggcgagaaguggaagcgccagcugaaccagcucuccaagagcgaguucaacacguacaagcgguccgggaucauggaggucgaccgcagcgaggccaaggagggccugaagcggggcgagaccaccaagcacgcggugucccgcgggaccgccaagcugcggugguucguggagcgcaaccuggucaagcccgagggcaaggugaucgaccucgggugcggccgcgggggcuggagcuacuacugcgccggccugaagaaggugacggaggucaagggguacaccaagggcgggcccggccacgaggagcccaucccgauggccaccuacggguggaaccuggugaagcuccacuccggcaaggacguguucuucacgccgcccgagaagugcgacacccugcugugcgacaucggcgagagcucccccaacccgacgaucgaggaggggcgcacccuccggguccugaagaugguggagcccuggcugcgcggcaaccaguucugcaucaagauccucaaccccuacaugcccagcguggucgagacccuggagcagaugcagcggaagcacgggggcaugcuggugcgcaacccgcucucccggaacagcacccacgagauguacuggguguccugcgccacgggcaacaucgucagcgcggugaacaugaccucccgcaugcugcugaaccgguucaccauggcccaccgcaagcccaccuacgagcgcgacguggaccucggggccggcacgcggcacgucgccguggagcccgagaucgccaaccuggacaucaucgggcagcgcaucgagaacaucaagaacgagcacaagagcaccuggcacuacgacgaggacaaccccuacaagaccugggcguaccacggcaccuacgaggugaagccguccgggagcgccuccagcauggucaacggcguggugcggcugcucacgaagcccugggacgucauccccauggugacccagaucgccaugaccgacaccacgcccuucggccagcagcgcguguucaaggagaaggucgacacccggaccccgcgccccaagcgggggaccgcccagaucauggaggugacggcccgcuggcuguggggcuuccugagccggaacaagaagccccgcaucugcacccgggaggaguucacccgcaagguccgguccaacgcggccaucggggccguguucguggacgagaaccaguggaacagcgccaaggaggcggucgaggacgagcgcuucugggaccucgugcaccgggagcgcgagcugcacaagcagggcaagugcgcgaccugcguguacaacaugauggggaagcgggagaagaagcugggcgaguucggcaaggccaaggggucccgcgccaucugguacauguggcucggcgcccgguuccuggaguucgaggcgcugggguucaugaacgaggaccacugguucagccgcgagaacucccucagcggcgucgagggggagggccugcacaagcugggcuacauccuccgggacaucuccaagauccccgggggcaacauguacgccgacgacacggccgggugggacacccgcaucaccgaggacgaccugcagaacgaggccaagaucaccgacaucauggagcccgagcacgcccugcucgcgacgagcaucuucaagcugaccuaccagaacaagguggugcgcguccagcggcccgccaaguccggcaccgugauggacgugaucagccgccgggaccagcgcggcuccgggcaggucggcaccuacgggcugaacacguucaccaacauggaggugcagcucauccggcagauggagagcgagggcaucuucucccccagcgagcuggagaacuccaaccuggccgagcgcgcccucgacuggcuggagaagcacgggguggagcggcugaagcgcauggccaucagcggcgacgacugcgucgugaagccgaccgacgaccgguucgcgaccgcccucacggcccugaacgacaugggcaaggugcgcaaggacaucccccagugcgagcccuccaagggguggaacgacuggcagcagguccccuucugcagccaccacuuccaccagcugaucaugaaggacggccgggagaucguggugccgugccgcaaccaggacgagcucgucgggcgggcccgcgugagccagggcgccggguggucccugcgggagaccgcgugccugggcaagagcuacgcccagauguggcagcucauguacuuccaccgccgggaccugcgccuggccgccaacgcgaucugcuccgccgugcccgucaacugggugcccaccagccggaccaccugguccauccacgcccaccaccaguggaugacgaccgaggacaugcucagcguguggaaccgcgucuggaucgaggagaaccccuggauggaggacaagacccacguguccagcugggccgacgugccguaccugggcaagcgcgaggaccaguggugcgggucccugaucggccucgccgcgcgggccaccugggccacgaacauccaggucgcccugaaccaggugcgccggcugaucgggaacgagaacuaccucgacuacaugaccagcaugaagcgcuucaagaacgaguccgaccccgagggcgcccugugguga

SEQ ID NO: 7985 - RNA, 9879 nt, Artificial Sequence
  derived and/or modified CDS sequence (opt1) from DENV-1__JQ922544__SS-prME
agcgugaccaugcugcucaugcugcugcccaccgcccucgccuuccaccugaccacccggggcggggagccccacaugaucguguccaagcaggagcggggcaagagccuccuguucaagaccuccgccggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgggacaagcgguccguggcccuggcgccccacgugggccuggggcucgagacccgcaccgagaccuggaugagcugcgagggcgccuggaagcagauccagaaggucgagaucugggcccugcggcaccccggguucaccgugaucgcccuguuccucgcgcacgccaucggcacguccaucacccagaaggggaucaucuucauccugcugaugcucgugacccccagcauggccaugcgcugcgucggcaucggcaaccgggaguucguggaggggcuguccggcgccaccuggguggacgucgugcuggagcacgggagcugccuccacacgauggcccagaacaagcccacccuggacaucgagcugcucaagaccgaggugaccaaccccgcgguccugcgcaagcugugcaucgaggccaagaucuccaacacgaccaccgacagccggugccccacccagggcgaggccacgcucguggaggagcaggacgccaacuucgugugccgccggaccuucgucgaccgcggcugggggaacggcugcgggcuguucggcaaggggucccugcugaccugcgccaaguucaagugcgugaccaagcuggagggcaagaucgugcaguacgagaaccugaaguacagcgucaucgugacggugcacaccggcgaccagcaccaggucgggaacgagaccaccacgcacggcaccaucgcgaccaucacgccccaggcccccaccuccgagauccagcucacggacuacggggcccugacccuggacugcagcccccggaccggccucgacuucaacgagauggugcugcugaccaugaaggagaaguccuggcucguccacaagcagugguuccuggaccugccgcuccccuggacgagcggggccuccaccagccaggagaccuggaaccgccaggaccugcuggugaccuucaagacggcccacgcgaagaagcaggagguggucgugcucggcagccaggagggcgccaugcacaccgcccugaccggggccaccgagauccagacguccggcaccaccaccaucuucgccgggcaccugaagugccggcucaagauggacaagcugacgcugaagggcaugagcuacgugaugugcaccggguccuucaagcuggagaaggaggucgcggagacccagcacggcaccgugcucgugcaggucaaguacgagggcacggacgcccccugcaagauccccuucagcacccaggacgagaagggggugacccagaacggccgccugaucaccgccaacccgaucgugacggacaaggagaagcccgucaacaucgaggccgagccgcccuucggggaguccuacaucguggugggcgcgggcgagaaggcccugaagcucagcugguucaagaagggguccagcaucggcaagauguucgaggccaccgcccgcggggcccgccggauggcgauccugggcgacaccgccugggacuucggguccaucggcggcgucuucaccagcguggggaagcuggugcaccaggucuucggcacggccuacgggguccucuucuccggcgugagcuggaucaugaagaucgggaucggcauccugcugaccuggcucggccugaacucccgcagcaccucccugagcaugaccugcaucgccgucgggauggugacgcucuaccugggcgugaugguccaggccgacuccgggugcgugaucaacuggaagggccgcgagcugaagugcgggagcggcaucuucgugaccaacgagguccacaccuggaccgagcaguacaaguuccaggcggacuccccgaagcggcucagcgccgccaucggcaaggccugggaggagggggugugcggcauccgcagcgccacgcggcuggagaacaucauguggaagcagaucuccaacgagcugaaccacauccuccuggagaacgacaugaaguucaccguggucgugggggacgcgaacggcauccuggcccaggggaagaagaugauccgcccccagcccauggagcacaaguacagcuggaaguccuggggcaaggccaagaucaucggcgccgacauccagaacaccaccuucaucaucgacgggcccgacaccccggagugccccgacgaccagcgggcguggaacaucugggagguggaggacuacggcuucgggaucuucacgaccaacaucuggcucaagcugcgcgacagcuacacccagaugugcgaccaccggcugauguccgccgccaucaaggacagcaaggccguccacgccgacaugggcuacuggaucgaguccgagaagaacgagaccuggaagcucgcgcgcgccagcuucaucgaggugaagacgugcaucuggcccaagucccacacccuguggagcaacggcgugcuggaguccgagaugaucauccccaagaucuacgggggcccgaucagccagcacaacuaccggcccggguacuucacccagaccgccggccccuggcaccucgggaagcuggagcuggacuucgaccucugcgagggcacgaccgucgugguggaggagcacugcggcaaccgcgggccgucccugcggaccaccacggucaccggcaagaucauccacgaguggugcugccgcagcugcacccugccgccccuccgguucaagggggaggacggcugcugguacgggauggagauccgccccgugaaggagaaggaggagaaccuggugcgguccauggucagcgccggcuccggcgagguggacagcuucagccuggggcuccugugcguguccaucaugaucgaggaggucaugcgcagccgguggucccgcaagaugcugaugaccggcacgcucgccguguuccugcugcucaucauggggcagcugaccuggaacgaccugauccggcucugcaucauggugggcgcgaacgccagcgaccgcauggggaugggcaccaccuaccuggcccugauggccacguucaagaugcgcccgauguucgccgucggccuccuguuccggcgccugaccucccgggaggugcuccugcugaccaucgggcucagccugguggcguccgucgagcugcccaacagccucgaggagcugggcgacgggcuggccaugggcaucaugaugcucaagcugcugaccgacuuccagucccaccagcucuggacgacccugcugagccucaccuucaucaagaccacgcugucccuggacuacgccuggaagaccauggccauggugcucagcaucgucucccuguucccccugugccucagcaccaccucccagaagacgaccuggcugcccgugcugcucggcagcuucgggugcaagccgcugaccauguuccugaucaccgagaacaagaucuggggccgcaaguccuggccccucaacgaggggaucauggcggugggcaucgucagcauccugcuguccagccuccugaagaacgacgugccccuggccgggccccucaucgccggcggcaugcugaucagcuucuucgugaucuccgggagcuccgccgaccugagccucgagaaggccgcggaggucuccugggaggaggaggccgagcacagcggcacgucccacaacauccugguggaggugcaggacgacgggaccaugaagaucaaggacgaggagcgggacgacacccugaccauccuccugaaggccacccugcucgccgucagcggcguguacccgauguccauccccgccacgcuguucgugugguacuucuggcagaagaagaagcagcgcagcgggguccugugggacacccccagcccgcccgagguggagcgggcggugcuggacgacggcaucuaccgcauccuccagcggggccugcuggggcgcagccaggucggcguggggguguuccaggacggcgucuuccacaccauguggcacgugacccgcggggccgugcucauguaccagggcaagcgccuggagcccuccugggccagcgucaagaaggaccugaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcgcucgacuucaagcccggcaccuccgggagccccaucgucaaccgcgagggcaagaucgugggccuguacgggaacggcguggucaccaccuccgggacguacgugagcgccaucgcccaggccaaggccagccaggagggcccgcugcccgagaucgaggacgagguguuccggaagcgcaaccucaccaucauggaccugcaccccggguccggcaagacccggcgcuaccugccggcgaucguccgggaggccaucaagcgcaagcuccggacccugauccuggcccccacgcgcgugguggccagcgagauggcggaggcccucaagggcaugcccauccgcuaccagaccaccgccgucaaguccgagcacaccgggcgggagaucguggaccugaugugccacgccacguucaccaugcgccugcucagccccgugcgggucccgaacuacaacaugaucaucauggacgaggcccacuucaccgaccccgcguccaucgccgcccgcggcuacaucagcacccggguggggaugggcgaggccgccgcgaucuucaugacggccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcugucccgcaagacguucgacaccgaguaccagaagaccaagaacaacgacugggacuacguggugaccacggacaucagcgagaugggggcgaacuuccgggccgaccgcgucaucgacccgcggcgcugccucaagcccgugauccugaaggacggccccgagcgggugauccuggccgggcccaugccggucaccguggccuccgcggcccagcgccggggccgcaucggccggaaccagaacaaggagggggaccaguacgucaacaugggccagccccucaacaacgacgaggaccacgcccacuggaccgaggccaagaugcugcuggacaacaucaacacccccgaggggaucauccccgcccucuucgagccggagcgcaagaaguccgcggccguggacggcgaguaccgccugcgcggggaggcccgcaagacguucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagcgcgagcggaagaagcuccgcccccgguggcuggacgcccgcaccuacagcgacccccuggcgcuccgggaguucaaggaguucgccgccggccgccggagcguguccggggaccugauccuggagaucggcaagcucccgcagcaccugacccugcgcgcccagaacgcccucgacaaccuggugaugcugcacaacagcgagcagggcgggaaggcguaccggcacgccauggaggagcuccccgacacgaucgagacccugaugcugcucgcccugaucgccguccugaccggcggggugacccucuucuuccuguccggcaaggggcugggcaagaccagcaucggccuccugugcgugauggcguccagcgcccugcucuggauggccuccgucgagccccacuggaucgccgccagcaucauccuggaguucuuccugauggugcuccugauccccgagccggaccgccagcggacgccccaggacaaccagcuggcguacguggucaucgggcuccuguucaugauccugaccguggccgccaacgagaugggccuccuggagaccaccaagaaggaccuggggaucggccacguggccgccgagaaccaccaccacgcgacgaugcucgacgucgaccugcgccccgccuccgccuggacccuguacgccguggccaccaccaucaucacgccgaugaugcggcacaccaucgagaacaccaccgcgaacaucagccucacggccaucgccaaccaggccgccauccugauggggcuggacaagggcuggcccaucucccucauggacaucggcgugccccugcuggcgcucgggugcuacagccaggucaacccccugacccugaccgccgccgugcucaugcugguggcccacuacgcgaucaucggcccggggcugcaggccaaggccacccgcgaggcccagaagcgcacggccgcgggcaucaugaagaaccccaccgucgacgggaucguggccaucgaccucgaccccguggucuacgacgccaaguucgagaagcagcugggccagaucaugcugcucauccugugcaccucccagauccugcucaugcggaccacgugggcccugugcgagagcaucacccuggccaccggcccccucaccacgcugugggagggguccccgggcaaguucuggaacaccaccaucgcggugagcauggccaacaucuuccgcggguccuaccuggccggcgccggccucgccuucagccugaugaagucccucgggggcgggcggcgcgggaccggggcgcagggcgagacgcucggcgagaaguggaagcggcagcugaaccagcugagcaagagcgaguucaacaucuacaagcgcuccgggaucauggagguggaccggagcgaggccaaggagggccugaagcgcggggagaccaccaagcacgccgucucccggggcaccgccaagcuccgcugguucguggagcggaaccuggugaagcccgaggggaaggucaucgaccugggcugcggccgcgggggcuggagcuacuacugcgcggggcucaagaaggugacggaggugaagggcuacaccaagggcgggcccggccacgaggagcccaucccgauggccaccuacggguggaaccuggucaagcugcacuccggcaaggacguguucuucacgccgcccgagaagugcgacacgcuccugugcgacaucggggagagcucccccaacccgaccaucgaggagggccggacccugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggacgggcaacaucgugagcgccgucaacaugaccucccggaugcuccugaaccgcuucaccauggcccaccgcaagcccaccuacgagcgggacguggaccugggggccggcacgcgccacguggcggucgagcccgagguggccaaccucgacaucaucggccagcggaucgagaacaucaagaacgagcacaagagcaccuggcacuacgacgaggacaaccccuacaagaccugggccuaccacggguccuacgaggugaagccgagcggcuccgccagcuccauggucaacggggugguccgccugcugaccaagcccugggacgugauccccauggugacgcagaucgccaugaccgacaccacccccuucggccagcagcgggucuucaaggagaagguggacacgcgcaccccgcgggcgaagcgcgggaccgcccagaucauggaggugaccgccaaguggcucuggggcuuccugagccggaacaagaagccccgcaucugcacgcgggaggaguucacccgcaagguccggagcaacgccgccaugggcgcgguguucguggacgagaaccaguggaacuccgccaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggcgaaggggagccgcgccaucugguacauguggcugggcgcccgguuccucgaguucgaggcccugggcuucaugaacgaggaccacugguucucccgcgagaacagccuguccggggucgagggcgaggggcuccacaagcugggcuacauccugcgggacaucagcaagauccccgggggcaacauguacgccgacgacaccgcgggcugggacacgcgcaucaccgaggacgaccuccagaacgaggccaagaucaccgacaucauggagccggagcacgcccugcuggccaccuccaucuucaagcucacguaccagaacaagguggugcgcguccagcggcccgccaagagcgggaccgugauggacgugaucucccgccgggaccagcgcggcagcgggcaggucggcaccuacggccugaacaccuucacgaacauggaggugcagcugauccggcagauggaguccgaggggaucuuccuccccagcgagcuggagacccccaaccuggcggagcgcgugcucgacuggcuggagaagcacggcgccgagcggcugaagcgcauggccaucuccggggacgacugcgucgugaagccgaucgacgaccgguucgccaccgcccucaccgcgcugaacgacaugggcaaggugcgcaaggacaucccccagugggagcccagcaagggguggaacgacuggcagcagguccccuucugcucccaccacuuccaccagcugaucaugaaggacggccgggagaucguggugccgugccgcaaccaggacaagcucgucggccgggcccgcgugagccagggggccggcuggucccugcgggagacggccugccugggcaagagcuacgcccagauguggcagcucauguacuuccaccgccgggaccugcgccuggcggccaacgccaucugcagcgccgugcccgucgacugggugcccaccucccggaccaccuggagcauccacgcgcaccaccaguggaugacgaccgaggacaugcucuccguguggaacaaggucuggaucgaggagaaccccuggauggaggacaagacccacgugagcuccugggaggacgugccguaccugggcaagcgcgaggaccaguggugcgggagccugaucggccucaccgcccgcgccaccugggccacgaacauccaggucgccaucaaccaggugcggcgccugaucggcaacgagaacuaccuggacuacaugaccuccaugaagcgguucaagaacgagagcgaccccgagggggcgcucugguga

SEQ ID NO: 7986 - RNA, 9879 nt, Artificial Sequence
  derived and/or modified CDS sequence (opt1) from DENV-1__JQ922546__SS-prME
agcguggccaugcugcucaugcugcugcccaccgcccucgccuuccaccugaccacccggggcggggagccccacaugaucgugagcaagcaggagcggggcaagagccugcuguucaagaccuccgccggggugaacaugugcacccugaucgccauggaccugggcgagcucugcgaggacaccaugacguacaaguggccccggaucaccgaggccgagcccgacgacguggacugcuggugcaacgccaccgacaccugggucaccuacgggaccugcagccagaccggcgagcaccggcgggacaagcgguccguggcgcuggcgccccacgugggccuggggcucgagacccggacggagaccuggaugagcuccgagggcgccuggaagcagauccagaaggucgagaccugggcccugcggcaccccggguucaccgugaucgcccuguuccucgcccacgccaucggcacgagcaucacccagaaggggaucaucuucauccugcugaugcucgugacccccuccauggccaugcgcugcgucggcaucggcaaccgggacuucguggaggggcugagcggcgccaccuggguggacgucgugcuggagcacggguccugcgugacgaccauggcgaagaacaagcccacccucgacaucgagcugcugaagaccgaggucacgaaccccgccgugcuccgcaagcugugcaucgaggccaagaucagcaacaccaccaccgacucccggugccccacgcagggcgaggccacccugguggaggagcaggacgccaacuucgucugccgccggaccuucguggaccgcggcugggggaacggcugcggccucuucggcaaggggagccugcugaccugcgcgaaguucaagugcgugacgaagcucgagggcaagaucguccaguacgagaaccugaaguacuccgugaucgugaccguccacaccggcgaccagcaccagguggggaacgagaccacggagcacggcaccaucgccaucaucacgccccaggcccccaccagcgagauccagcugaccgacuacggggcccucacgcuggacugcagcccccggaccggccuggacuucaacgagaugguccuccugaccaugaaggagaaguccuggcuggugcacaagcagugguuccucgaccugccgcugcccuggaccuccggggccagcacgagccaggagaccuggaaccgccaggaccuccuggugaccuucaagaccgcgcacgccaagaagcaggaggucguggugcugggcucccaggagggcgccaugcacacggcccucaccggggccaccgagauccagaccagcggcacgaccaccaucuucgcggggcaccugaagugccggcugaagauggacaagcucacccugaagggcauguccuacgucaugugcacggggagcuucaagcuggagaaggagguggccgagacccagcacggcaccgugcugguccaggugaaguacgagggcaccgacgcccccugcaagauccccuucuccauccaggacgagaagggggugacgcagaacggccgccucaucaccgccaacccgaucgucaccgacaaggagaagcccgugaacaucgagaccgagccgcccuucggggagagcuacaucguggucggcgcgggcgagaaggcccugaagcuguccugguucaagaaggggagcuccaucggcaagauguucgaggccacggcccgcggggcccgccggauggcgauccucggcgacaccgccugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggcggacagcccgaagcggcugagcgccgccaucggcaaggccugggaggagggggugugcggcauccgcuccgccacgcggcucgagaacgucauguggaagcagaucagcaacgagcugaaccacauccugcucgagaacgacaugaaguucaccgugguggucggggacgugaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacgaccagcgggccuggaacaucugggagguggaggacuacggcuucgggaucuucacgaccaacaucuggcugaagcuccgcgacuccuacacccaggucugcgaccaccggcugaugagcgcggccaucaaggacuccaaggccgugcacgccgacaugggcuacuggaucgagagcgagaagaacgagaccuggaagcuggcccgcgcguccuucaucgaggugaagacgugcaccuggcccaagagccacacccucugguccaacggcguccuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgugguggucgacgagcacugcggcaaccgcgggccgagccuccggaccacgaccgugaccggcaagaucauccacgaguggugcugccgcuccugcacccugccgccccugcgguucaagggggaggacggcugcugguacgggauggagauccgccccgugaaggagaaggaggagaaccucguccggagcaugguguccgccggcagcggcgagguggacagcuucucccuggggcugcucugcgucagcaucaugaucgaggaggugaugcgcucccgguggagccgcaagaugcugaugacgggcacccuggccguguucuuccuccugaucauggggcagcugaccuggaacgaccucuuccggcugugcaucauggucggcgccaacgcguccgaccgcauggggaugggcaccacguaccuggcccucauggccaccuucaagaugcgcccgauguucgccguggggcugcuguuccggcgccucaccagccgggagguccugcugcucaccaucgggcugucccugguggccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggccaugguccuguccaucgugagccugagcccccucugccugagcaccacgucccagaagaccaccuggcugcccgugcuccugggcagcuucgggugcaagccgcugaccauguuccucaucacggagaacaagaucuggggccgcaaguccuggccccugaacgaggggaucauggccgucggcaucgugagcauccugcucagcucccugcugaagaacgacgugccccucgcggggccccugaucgccggcggcaugcugaucgccugcuacgucaucagcggguccagcgccgaccucucccuggagaaggccgcggaggugagcugggaggaggaggccgagcacuccggcgccagccacaacauccugguggagguccaggacgacgggaccaugaagaucaaggacgaggagcgggacgacacccucaccauccugcugaaggccucccuccuggccgugagcggcguguacccgauguccauccccgcgacccuguucgucugguacuucuggcagaagaagaagcagcgcagcggggugcucugggacacgcccagcccgcccgagguggagcgggccguccuggacgacggcaucuaccgcauccugcagcggggccugcucgggcgcagccaggugggcguggggaucuuccaggacggcgucuuccacaccauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaaccccaagaacgugcagacgacccccggcaucuucaagacccccgagggcgaggugggggcgaucacccuggacuucaagcccggcacguccgggagccccaucgucaaccgcgagggcaagaucgugggccuguacgggaacggcguggucaccaccagcgggaccuacguguccgccaucgcccaggccaaggccagccaggagggcccgcuccccgagaucgaggacgagguguuccggaagcgcaaccugacgaucauggaccugcaccccggguccggcaagacccggcgcuaccucccggcgaucguccgggaggccaugaagcgcaagcugcggacccugauccucgcccccacccgcgugguggccagcgagauggcggaggcccugaagggcaugcccauccgcuaccagacgaccgccgucaaguccgagcacaccgggcgggagaucguggaccugaugugccacgccaccuucacgaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugaccgccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggcgaacuuccgggccgaccgcgucaucgacccgcggcgcugccugaagcccgugauccugaaggagggccccgagcgggucauccucgccgggcccaugccggugacgguggccuccgcggcccagcgccggggccgcaucggccggaaccagaacaaggagggggaccaguacgucuacaugggccagccccugaacaacgacgaggaccacgcccacuggaccgaggccaagaugcugcucgaccacaucaacacccccgaggggaucauccccgcccuguucgagccggagcgcgagaaguccgcggccaucgacggcgaguaccgccugcgcggggaggcccgcaagaccuucguggagcucaugcggcgcggcgaccugcccguguggcuguccuacaaggucgccagcgagggcuuccaguacacggaccggcgcuggugcuucgacggggagcggaacaaccaggugcucgaggagaacauggacguggagaucuggauggaggagggcgagaagaagaagauccgcccccgguggcuggagaucgagaaguacagcgacccccuggcccuccgcgaguucaaggaguucuccgcgaagcgcaagagcguccugggggaccugaagcucgagaucggcaagcugccgcagcaccugaccaucaaggcccgcaacgcccucgacaaccuggugaugcugcacaacuccgagcagggcgggaaggccuaccggcacgccauggaggagcuccccgacaccaucgagacccugaugcgccugggccucaucgcggugaugaccggcggggucacccuguucuuccugagcgggaaggggcucggcaagaccuccaacgggcugcugugcgugauggccagcuccgugcuccuguggauggccagcgucgagccccacuggaucgccgcguccaucauccuggaguucuuccucauggugcugcugauccccgagccggaccggcagcgcacgccccaggacaaccagcucgccuacguggucaucggccugcuguucaugauccucaccguggccgccaacgagauggggcugcuggagacgaccaagaaggaccucggcaucgggcacguggucgccgagaaccaccaccacgcgaccaugcuggacguggaccugcaccccgccagcgccuggacccucuacgccguggccacgaccaucaucaccccgaugaugcggcacaccaucgagaacacgaccgcgaacaucucccugaccgccaucgccaaccaggccgccauccugaugggccucgacaagggcuggcccaucagcaagauggacaucggggucccccugcuggcgcucggcugcuacucccaggugaacccccugacccugacggccgccgugcucaugcuggucgcccacuacgccaucaucgggccgggccugcaggcgaaggccacccgcgaggcccagaagcggaccgcgccccagaucaugaagaaccagaucguggacgggaucguggcggucgaccucgaccccgugguguacgacgccaaguucgagaagcagcugggccagaucaugcugcucauccugugcaccagccagauccugcucaugcgcacgaccugggcccugugcgaguccaucacccuggccaccggcccccucacgacccugugggaggggagcccgggcaaguucuggaacaccaccaucgccgucuccauggcgaacaucuuccgggggagcuaccuggccggcgccggccucgccuucucccugaugaagucccucgggggcgggcgccgcgggacgggggcccagggcgagacccucggcgagaaguggaagcggcagcugaaccagcugagcaaguccgaguucaacaccuacaagcgcagcgggaucauggagguggaccgguccgaggcgaaggagggccucaagcgcggggagaccacgaagcacgccgugagccggggcaccgccaagcugcgcugguucgucgagcggaaccuggugaagcccgaggggaaggugaucgaccucggcugcggccgcgggggcugguccuacuacugcgccgggcugaagaaggucaccgaggugaagggcuacaccaagggcgggcccggccacgaggagcccaucccgauggccacguacggguggaaccuggugaagcugcacagcggcaaggacgucuucuucacgccgcccgagaagugcgacacccuccugugcgacaucggggaguccagccccaacccgaccaucgaggagggccggacgcugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggaccggcaacaucguguccgcggugaacaugaccagccggaugcuccugaaccgcuucacgauggcccaccggaagcccaccuacgagcgcgacgucgaccugggggccggcacccggcacguggccgucgagcccgagguggcgaaccucgacaucaucggccagcgcaucgagaacaucaagaacgagcacaaguccaccuggcacuacgacgaggacaaccccuacaagacgugggccuaccacgggagcuacgaggugaagccguccggcagcgccuccagcauggucaacgggguggugcgccugcugaccaagcccugggacgucauccccaccgugacccagaucgccaugacggacaccacccccuucggccagcagcggguguucaaggagaaggucgacacccgcacgccgaaggccaagcgggggaccgcgcagaucauggaggugaccgccaacuggcucuggggcuuccugagccgcaacaagaagccccggaucugcacccgcgaggaguucacgcggaaggugcgcuccaacgccgccaucggcgccgucuucguggacgagaaccaguggaacagcgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucacggaggacgaccuccagaacgaggcgaagaucaccgacaucauggagccggagcacgcccugcuggccaccagcaucuucaagcucaccuaccagaacaaggucgugcgcgugcagcggcccgccaaguccgggacggucauggacgugaucagccgccgggaccagcgcggcuccggccaggugggcaccuacggccugaacaccuucaccaacauggagguccagcugauccgccagauggagagcgaggggaucuuccuccccuccgagcuggagacgcccaaccuggccgagcgggugcucaacuggcuggagaagcacggcguggagcgccugaagcggauggcgaucagcggggacgacugcgucgugaagccgaccgacgaccgcuucgccaccgcccucaccgcccugaacgacaugggcaaggugcggaaggacacgccccagugggagcccuccaagggguggaacgacuggcagcagguccccuucugcagccaccacuuccaccagcugaucaugaaggacggccgcgagaucguggugccgugccggaaccaggacgagcucgucggccgcgcccgggugucccacggggcgggcuggagccugcgcgagaccgccugccugggcaagagcuacgcccagauguggcagcucauguacuuccaccggcgcgaccugcggcuggccgccaacgcgaucugcuccgccgugcccgucgacugggugcccaccagccgcaccacgugguccauccacgcccaccaccaguggaugaccaccgaggacaugcucagcguguggaaccgggucuggaucgaggagaaccccuggauggaggacaagacccacguguccagcugggaggacgugccguaccugggcaagcgcgaggaccaguggugcggguccaucaucggccugaccgcccgggccacgugggcgaccaacauccaggucgccaucaaccaggugcgccggcucaucggcaacgagaacuaccuggacuacaugaccagcaugaagcgcuucaagaacgaguccgaccccgagggggcccugugguga

SEQ ID NO: 7987 - RNA, 9879 nt, Artificial Sequence
  derived and/or modified CDS sequence (opt1) from DENV-1__JQ922545__SS-prME
agcgugaccaugcugcucaugcugcugcccaccgcccucgccuuccaccugaccacccggggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcagcgagggcgccuggcggcagauccagaaggucgagaccugggcccugcgccaccccggguucacggugaucgcccuguuccucgcgcacaccaucggcaccagcaucacccagaaggggaucaucuucauccugcugaugacgggcgcccccaucauggccaugcggugcgugggcaucgggaaccgcgacuucgucgagggccucagcggggcccccuggguggacgugguccuggagcacggcagcugccuguccaacauggccaagaacaagcccacccucgacaucgacuucuucaagaccgaggugaccaacccggcggugcugcggaagcugugcaucgaggccaagaucagcaacacgaccaccgacucccgcugccccacccagggcgaggccacgcucgucgaggagcaggacgccaacuucgugugccggcgcaccuucguggaccggggguggggcaacgggugcggccuguucgggaagggcagccugcugaccugcgccaaguucaagugcgucaccaagcuggagggcaagaucgugcaguacgagaaccugaaguacuccgugaucgucacggugcacaccggggaccagcaccaggugggcaacgagaccaccgagcacgggacgaucgcgaccaucacgccccaggcccccaccagcgagauccagcucaccgacuacggcgcccugacgcuggacugcuccccgcgcaccgggcucgacuucaacgagaugguccugcugaccaugaaggagaaguccuggcucgugcacaagcagugguuccuggaccugccccuccccuggaccuccggcgccagcacgagccaggagaccuggaaccggcaggaccugcuggucaccuucaagaccgcccacgcgaagaagcaggagguggugguccucggcucccaggagggggccaugcacacggcccugaccggcgccaccgagauccagaugagcgggaccacgaccaucuucgccggccaccugaagugccgccucaagauggacaagcugacccugaaggggguguccuacgugaugugcaccggcagcuucaagcucgagaaggaggucgcggagacgcagcacggcaccgugcuggugcaggucaaguacgaggggaccgacgcccccugcaagaucccguucuccacccaggacgagaagggcgugacgcagaacgggcggcugaucaccgccaaccccaucgugaccgacaaggagaagcccgucaacaucgagaccgagcccccguucggcgagagcuacaucgugaucggcgccggggagaaggcgcugaagcucuccugguucaagaagggcagcuccaucgggaagauguucgaggccacggcccgcggcgcccggcgcauggccauccugggggacaccgcgugggacuucggcagcaucggcgggguguucaccuccgucggcaagcuggugcaccagguguucgggaccgccuacggcguccucuucagcgggguguccuggacgaugaagaucggcaucggcauccugcugaccuggcucgggcugaacagccgcuccaccagccuguccaugaccugcaucgccgugggcauggucacgcucuaccugggggugauggugcaggccgacagcggcugcgucaucaacuggaaggggcgggagcugaagugcggcuccggcaucuucgugaccaacgaggugcacaccuggaccgagcaguacaaguuccaggccgacagccccaagcgccucagcgcggccaucgggaaggccugggaggagggcgucugcgggauccgguccgccacgugccuggagaacaucauguggaagcagaucagcaacgagcugaaccacauccuccuggagaacgacaugaaguucaccgugguggucggcgacgccaacgggauccugacccagggcaagaagaugauccgcccccagcccauggagcacaaguacuccuggaaguccuggggcaaggcgaagaucaucggggccgacauccagaacaccaccuucaucaucgacggcccggacacgcccgagugccccgacgaccagcgggccuggaacaucugggagguggaggacuacggguucggcaucuucaccaccaacaucuggcucaagcugcgcgacuccuacacccagaugugcgaccaccggcugaugagcgccgcgaucaaggacuccaaggccgugcacgccgacaugggcuacuggaucgagagcgagaagaacgagacguggaagcucgcccgcgccuccuucaucgaggucaagaccugcaucuggccccggagccacacccugugguccaacggggugcuggagagcgagaugaucaucccgaagaucuacggcgggcccaucucccagcacaacuaccgccccggcuacuucacccagacggcggggccguggcaccucggcaagcuggagcuggacuucgaccucugcgagggcaccaccguggucguggacgagcacugcgggaaccggggccccagccugcgcaccacgaccgugaccgggaagaucauccacgaguggugcugccgguccugcacccugccgccccuccgcuucaagggcgaggacgggugcugguacggcauggagauccggccggucaaggagaaggaggagaaccuggugcgcagcaugguguccgccggcagcggggaggucgacagcuucucccugggccuccugugcgugagcaucaugaucgaggaggugaugcggucccgcuggagccggaagaugcugaugacggggacccucgccgucuucuuccugcugaucaugggccagcucaccuggaacgaccugauccgccugugcaucauggugggggccaacguguccgaccgcaugggcaugggcaccacguaccucgcccugauggcgaccuucaagaugcggcccauguucgccgucgggcuccucuuccgccggcugaccagccgcgaggugcugcuccugaccaucgggcugucccucguggccagcgucgagcugcccaacucccuggaggagcucggggacggccuggccaugggcaucaugaugcugaagcuccugacggacuuccagagccaccagcuguggaccacccuccugucccugaccuucaucaagacgacccucagccuggacuacgccuggaagaccaucgcgauggugcuguccaucgucagccucuucccccugugccuguccaccacgagccagaagaccaccuggcucccggugcugcugggguccuucggcugcaagccccucaccauguuccugaucacggagaacaagaucugggggcgcaagagcuggccccugaacgagggcaucauggccguggggaucgucuccauccuccugagcagccugcucaagaacgacgugccccuggccggcccgcugaucgccggcgggaugcucaucgcgugcuacgugaucuccggcagcuccgccgaccugagccuggagaaggccgccgaggucuccugggaggaggaggcccagcacagcggggcgucccacaacauccucguggaggugcaggacgacggcaccaugaagaucaaggacgaggagcgcgacgacacccugaccauccugcucaaggccacccugcuggccgucagcgggguguaccccauguccauccccgccacccucuucgugugguacuucuggcagaagaagaagcagcggagcggcguccugugggacacccccuccccgcccgagguggagcgcgccgugcuggacgacggcaucuaccggauccuccagcgcgggcugcugggccggagccaggucggggugggcguguuccaggacggggucuuccacaccauguggcacgugacccgcggcgcggugcugauguaccagggcaagcggcucgagcccuccugggccagcgucaagaaggaccugaucuccuacgggggcggguggcgcuuccagggcagcuggaacacgggggaggagguccaggugaucgccgucgagcccggcaagaacccgaagaacgugcagaccacccccggcaccuucaagacgcccgagggggaggugggcgccaucgcccuggacuucaagcccgggaccuccggcagcccgaucgucaaccgggagggcaagaucguggggcucuacggcaacgggguggucaccaccuccggcacguacgugagcgcgaucgcccaggccaaggccagccaggaggggccccugcccgagaucgaggacgagguguucaagaagcgcaaccugaccaucauggaccuccacccgggcuccggcaagacccggcgcuaccugcccgccaucguccgggaggcgaucaagcgcaagcugcggacccucauccuggcccccacgcgcgugguggccagcgagauggccgaggcgcugaaggggaugcccauccgcuaccagaccaccgccgucaaguccgagcacaccggccgggagaucguggaccucaugugccacgccacguucaccaugcgccugcugagcccggugcggguccccaacuacaacaugaucaucauggacgaggcccacuucaccgaccccgccuccaucgcggcccgcggguacaucagcacccgggugggcaugggggaggccgccgccaucuucaugacggcgacgcccccgggcuccguggaggccuucccccagagcaacgccgucauccaggacgaggagcgcgacauccccgagcgguccuggaacagcggcuacgacuggaucaccgacuuccccgggaagaccgugugguucgugccguccaucaagagcggcuccgacaucgccacgguccucgagcgcagccgggagcccgugauccagcugucccgcaagaccuucgacaccgaguaccagaagaccaagaacaacgacugggacuacguggucacgaccgacaucagcgagaugggggccaacuuccgggcggaccgcgugaucgacccccggcgcugccugaagcccgugaucccgaaggacggccccgagcgggucauccucgccgggcccaugcccgugaccgucgccuccgccgcgcagcgccggggccgcaucggccggaaccagaacaaggagggggaccaguacaucuacaugggccagccgcugaacaacgacgaggaccacgcccacuggaccgaggccaagaugcugcucgacaacaucaacacgcccgaggggaucauccccgcccuguucgagcccgagcgcgagaaguccgccgcgaucgacggcgaguaccgccugcgcggggaggcccgcaagaccuucguggagcucaugcggcgcggcgaccugccgguguggcuguccuacaaggucgccagcgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccccucgcccugcgcgaguucaaggaguucgcggccgggcggcgcagcgucuccggcgaccugauccucgagaucgagaagcugccccagcaccugacgcuccgggcccagaacgcccuggacaaccuggugaugcuccacaacagcgagcagggcgggaaggccuaccgccacgcgauggaggagcugccggacaccaucgagacccugaugcuccuggcccugaucgccgugcucaccggcggggucacccuguucuuccuguccggcaaggggcucggcaagacgagcaucggccugcugugcgugauggccuccagcgugcuccuguggauggcguccgucgagccccacuggaucgccgccagcaucauccuggaguucauccucauggugcugcugauccccgagccggaccggcagcgcacgccccaggacaaccagcucgccuacguggucaucgggcugcuguucaugauccucaccguggccgcgaacgagaugggccugcuggagaccacgaagaaggaccucgggaucggccacguggucgccgagaaccaccaccacgccaccaugcuggacaucgaccugcaccccgccuccgccuggacccucuacgcgguggccaccacgaucaucacccccaugaugcggcacaccaucgagaacaccacggccaacaucagccugaccgccaucgccaaccaggcggccauccugauggggcucgacaagggcuggccgaucuccaagauggacaucggcgugccccugcuggcccucgggugcuacagccaggucaacccccugacccugaccgccgccgugcucaugcugguggcgcacuacgccaucaucggccccgggcugcaggccaaggccacgcgcgaggcgcagaagcggaccgccgccggcaucaugaagaacccgaccgucgacgggaucguggccaucgaccucgaccccguggucuacgacgccaaguucgagaagcagcugggccagaucaugcugcucauccugugcaccucccagauccugcucaugcgcacgaccugggcgcugugcgagagcaucacccuggccaccggcccccucacgacccugugggaggggucccccggcaaguucuggaacaccaccaucgccgugagcauggccaacaucuuccgcggguccuaccuggccggcgcgggccucgccuucagccugaugaagucccucgggggcgggcggcgcgggacgggggcccagggcgagacccucggcgagaaguggaagcggcagcugaaccagcuguccaagagcgaguucaacaccuacaagcgcuccgggaucauggagguggaccggagcgaggccaaggagggccucaagcgcggggagaccacgaagcacgccgucucccggggcaccgcgaagcugcgcugguucguggagcggaaccuggugaagccggaggggaaggucaucgaccucggcugcggccgcgggggcuggagcuacuacugcgccgggcugaagaaggugaccgaggugaagggcuacaccaagggcgggcccggccacgaggagcccauccccauggccacguacggguggaaccuggucaagcugcacuccggcaaggacguguucuucaccccgcccgagaagugcgacacccuccugugcgacaucggggagagcucccccaaccccaccaucgaggagggccggacccugcgcgugcucaagauggucgagccguggcugcgggggaaccaguucugcaucaagauccugaaccccuacaugcccagcgugguggagacgcucgagcagaugcagcgcaagcacggcggcaugcugguccggaacccccugucccgcaacagcacccacgagauguacuggguguccugcgggaccggcaacaucgugagcgccgucaacaugaccucccggaugcuccugaaccgcuucacgauggcgcaccggaagccgaccuacgagcgcgacguggaccugggggccggcacccgccacguggccgucgagcccgagaucgccaaccucgacaucaucggccagcggaucgagaacaucaagaucgggcacaagagcaccuggcacuacgacgaggacaaccccuacaagacgugggccuaccacggcuccuacgaggugaagcccagcggguccgcgagcagcauggugaacggcgucgugcgccugcugaccaagccgugggacgucauccccauggugacccagaucgccaugaccgacacgacccccuucgggcagcagcggguguucaaggagaaggucgacacccgcaccccgcggcccaagcgcggcacggcccagaucauggaggugaccgccaaguggauguggggcuuccucuuccggaaccggccgccccggaucugcacccgcgacgaguucgcccggaaggugcgcuccagcaccgcgaacggggccgucuucguggacgagaaccaguggaacuccgccaaggaggccguggaggacgagcgguucugggaccugguccaccgcgagcgggagcugcacaagcagggcaagugcgccacgugcguguacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagaucccgggcggcaacauguacgcggacgacaccgccgggugggacacccggaucaccgaggacgacuccagcaacgaggccaagaucaucgagcugaugcgccccgagcacgcccuccuggccacguccaucuucaagcugaccuuccagaucagcgucgugcgcgugcagcggcccgcgaaguccggcaccgucauggagugcaucagccgccgggaccagaagcgcuccggccaggugggcaccuacggccucaacacguucaccaacauggaggugcagcugauccggcagauggagagcgaggggaucuucucccccagcgagauggagaacagcaaccuggccgagcgcguccucgacuggcuggagaagcacggcguggagcggcugaagcgcauggccaucuccggggacgacugcguggucaagccgaccgacgaccgguucgccaccgcccucacggcgcugaacgacaugggcaaggugcgcaaggacaucccccagugggagcccagcaagggguggaacgacuggcagcagguccccuucugcucccaccacuuccaccagcugaucaugaaggacggccgggagaucgucgugccgugccgcaaccaggacgagcucgugggccgggcccgcgucagccagggggccggcuggucccugcgggagaccgccugccugggcaagagcuacgcccagauguggcagcucauguacuuccaccgccgggaccugcgccuggcggccaacgccaucugcuccgccgugcccguggacuggguccccaccagccggaccacgugguccauccacgcccaccaccaguggaugaccaccgaggacaugcucagcguguggaaccgcguguggaucgaggagaaccccuggauggaggacaagacccacgucuccagcugggaggacgugccguaccugggcaagcgcgaggaccaguggugcgggucccugaucggccucaccgcgcgggccacgugggccaccaacauccagguggccaucaaccagguccgccggcugaucggcaacgagaacuaccuggacuacaugaccagcaugaagcgcuucaagaacgaguccgaccccgagggggcgcucugguga

SEQ ID NO: 7988 - RNA, 9879 nt, Artificial Sequence
  derived and/or modified CDS sequence (opt1) from DENV-1__GU131887__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagauccgguacgagggcaccgacgcccccugcaagauccccuucagcacccaggacgagcgcggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccggauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcucaagcugcgcgacagcuacacccaggucugcgaccaccggcugauguccgccgccaucaaggacagcaaggccgugcacgccgacaugggcuacuggaucgaguccgagaagaacgagaccuggaagcucgcgcgcgccagcuucaucgaggugaagaccugcaucuggcccaagucccacacgcuguggagcaacggcguccuggaguccgagaugaucauccccaagaucuacgggggcccgaucagccagcacaacuaccggcccggguacuucacccagaccgccggccccuggcaccucgggaagcuggagcuggacuucgaccucugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgcuggucccggaagaugcugaugaccggcacccucgccguguuccugcugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucgggcuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgcuaccucccggccaucguccgggaggccaucaagcgcaagcugcggacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacaccaucgagacgcugaugcugcucgcccugaucgccgcccugaccggcggggugacccucuucuuccuguccggccgcgggcugggcaagaccagcaucggccuccugugcgugauggcguccagcguccugcucuggauggccuccguggagccccacuggaucgccgccagcaucauccuggaguucuuccugauggugcuccugauccccgagccggaccgccagcggacgccccaggacaaccagcuggccuacgucgugaucgggcuccuguucaugauccugacgguggcggccaacgagaugggccuccuggagaccaccaagaaggaccuggggaucggccacgucgccguggggaaccaccaccacgccgccaugcucgacguggaccugcaccccgcguccgccuggacccuguacgccgucgccacgaccaucaucaccccgaugaugcgccacaccaucgagaacacgaccgccaacaucagccucaccgcgaucgccaaccaggccgccauccugaugggccuggacaagggcuggcccaucuccaagauggacaucggggugccccuccuggcgcugggcugcuacagccaggugaacccccucacccugacggccgccguccugaugcucguggcccacuacgccaucaucgggccgggccugcaggcgaaggccacccgggaggcccagaagcgcaccgccgccgggaucaugaagaaccccaccguggacggcaucgucgcgaucgaccuggaccccgugguguacgacgccaaguucgagaagcagcucggccagaucaugcugcugauccucugcacgucccagauccugcugaugcggaccaccugggcccucugcgagagcaucacccuggccacggggccccugaccacccucugggagggcuccccggggaaguucuggaacaccacgaucgccgucagcauggcgaacaucuuccgcggcuccuaccuggccggcgccgggcuggccuucagccucaugaagucccugggcgggggccggcgcgggaccggcgcgcagggcgagacccugggggagaaguggaagcggcagcucaaccagcuguccaagagcgaguucaacaccuacaagcgcuccggcaucauggagguggaccggagcgaggccaaggaggggcugaagcgcggcgagaucacgaagcacgccgugucccgggggaccgccaagcuccgcugguucgucgagcggaaccuggugaagcccgagggcaaggugaucgaccugggcugcgggcgcggcggguggagcuacuacugcgccggccugaagaaggucaccgaggugaagggguacaccaagggcggccccgggcacgaggagcccaucccgauggcgacguacggcuggaaccucgugaagcugcacuccgggaaggacgucuucuucgugccgcccgagaagugcgacacccugcucugcgacaucggcgagagcucccccaacccgaccaucgaggaggggcggacccugcgcgugcugaagauggucgagcccuggcuccggggcaaccaguucugcaucaagauccugaaccccuacaugcccagcgugguggagacgcuggagcagaugcagcgcaagcacggcgggaugcucguccgcaacccgcugucccggaacagcacccacgagauguacuggguguccugcggcaccgggaacaucgugagcgccgucaacaugaccucccgcaugcugcucaaccgguucaccauggcccaccgcaagcccacguacgagcgggacguggaccugggcgccggcacccgccacguggccgucgagcccgagguggcgaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcuccugacgaagcccugggacgugauccccauggugacccagaucgccaugaccgacaccacgcccuucgggcagcagcgcgucuucaaggagaagguggacacccggaccccgaaggccaagcgcggcaccgcgcagaucauggaggugacggccaaguggcuguggggcuuccucucccggaacaagaagccccgcaucugcacccgggaggaguucacccgcaagguccggagcaacgccgccaucggggcgguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcgucgagggggagggccugcacaagcucggguacauccugcgcgacaucagcaagauccccggcggcaacauguacgccgacgacacggccgggugggacacccggaucaccgaggacgaccugcagaacgaggcgcgcaucaccgacaucauggagccggagcacgcccuccuggccaaguccaucuucaagcugacguaccagaacaagguggugcggguccagcgccccgccaagaacggcaccgugauggacgugaucagccggcgcgaccagcggggguccggccaggucggcaccuacgggcucaacaccuucacgaacauggaggcccagcugauccgccagauggagagcgagggcaucuucucccccagcgagcuggagacccccaaccucgcggagcgggugcuggacuggcuggagaaguacgggguggagcgccucaagcggauggccaucuccggcgacgacugcgucgugaagccgaucgacgaccgcuucgccaccgcccugaccgcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcgcgggugagccagggcgccggguggagccugcgcgagacggccugccucggcaaguccuacgcccagauguggcagcugauguacuuccaccggcgcgaccugcgccucgcggccaacgccaucugcagcgccgugcccgucgacuggauccccaccucccggaccaccuggagcauccacgcccaccaccaguggaugacgaccgaggacaugcuguccguguggaaccgcguguggaucgaggagaaccccuggauggaggacaagacccacaucagcuccuggggcgacgucccguaccugggcaagcgggaggaccaguggugcggcagccucaucgggcugaccgcgcgcgccacgugggccaccaacauccagguggccaucaaccaggugcggcgccugaucggcaacgagaacuaccucgacuacaugaccuccaugaagcgguucaagaacgagagcgaccccgagggggcccugugguga

SEQ ID NO: 7989 - RNA, 9879 nt, Artificial Sequence
  derived and/or modified CDS sequence (opt1) from DENV-1__GU131888__SS-prME
agcgugaccaugcugcucaugcugaugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagagcgccuggaagcagauccagcgggucgagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugccccacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccgcuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuuccugacccaggacgagaagggcgucacgcagaacgggcggcugaucaccgccaacccgaucgugaccgacaaggagaagcccgugaacaucgaggccgagccgcccuucggcgaguccuacaucgucaucggggcgggcgagaaggcccucaagcugagcugguucaagaagggcuccagcaucgggaagauguucgaggccaccgcccgcggcgcccggcgcauggcgauccugggggacacgggcugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgccggcauccuggcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgcggccaucaaggacagcaaggccgugcacgccgacaugggcuacuggaucgaguccgagaagaacgagaccuggaagcuggcccgggcgagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguuccuccugcugaucauggggcagcucacguggaacgaccugauccgccugugcaucauggugggcgccaacgcgagcgaccgcauggggaugggcaccaccuaccucgcccugauggccaccuucaagaugcggccgauguucgccgucgggcuccuguuccgccggcugacgucccgcgaggugcugcuccugaccaucgggcugagccucguggccuccgucgagcugcccaacagccuggaggagcucggcgacgggcuggcgaugggcaucaugauccugaagcuccugaccgacuuccagucccaccagcugugggccacccuccugagccugacguucaucaagaccaccuucucccuccacuacgccuggaagaccauggccauggugcugagcaucgucucccuguucccccucugccugagcacgaccucccagaagaccaccuggcugcccgugcuccugggcagccuggggugcaagccgcucacgauguuccugaucgcggagaacaagaucuggggccggcgcuccuggccccugaacgaggggaucauggccgugggcaucgucagcauccuccugagcucccugcucaagaacgacgugccccuggccgggccccugaucgccggcggcaugcucaucgccugcuacgugaucagcggguccagcgcggaccugucccuggagaaggccgccgaggucagcugggaggaggaggccgagcacuccggcgccagccacaacauccucguggaggugcaggacgacgggccgaugaagaucaaggacgaggagcgggacgacacccugaccauccugcucaaggcgacccugcuggccgucuccggcguguacccccucagcauccccgccacccuguucgugugguacuucuggcagaagaagaagcagcgcuccgggguccugugggacacgcccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgccgugcugauguaccaggggaagcgccucgagcccagcugggcguccgucaagaaggaccugaucagcuacggcggcggguggcggcugcagggcuccuggaacaccggggaggagguccaggugaucgccgucgagcccggcaagaacccgaagaacgugcagacggcccccgggaccuucaagacccccgagggcgaggugggcgccaucgcccucgacuucaagcccgggaccagcggcuccccgaucgucaaccgcgaggggaagaucgugggccuguacggcaacgggguggucacgaccagcggcaccuacgugagcgcgaucgcccaggccaaggccucccaggaggggccccugcccgagaucgaggacgagguguuccggaagcgcaaccucaccaucauggaccugcacccgggcagcgggaagacgcggcgcuaccugcccgcgaucguccgggaggccaucaagcgcaagcuccgcacccugauccuggcccccacccgggugguggccuccgagauggccgaggcgcucaagggcaugcccauccgcuaccagaccacggccgucaagagcgagcacaccggcaaggagaucguggaccugaugugccacgccaccuucaccaugcggcugcucuccccggugcgcguccccaacuacaacaugaucaucauggacgaggcccacuucacggaccccagcuccaucgccgcgcggggguacaucagcacccgcgugggcaugggggaggccgccgccaucuucaugaccgccacgccgcccggcuccguggaggcguucccccagagcaacgcccugauccaggacgaggagcgggacauccccgagcgcuccuggaacagcggguacgaguggaucacggacuuccccggcaagaccgucugguucgugcccuccaucaagagcggcaacgacaucgccaacugccugcggaagaacgggaagcgcgugauccagcucucccggaagaccuucgacaccgaguaccagaagacgaagaacaacgacugggacuacgucgugaccaccgacaucagcgagaugggcgccaacuuccgcgcggaccgggugaucgacccccgccggugccugaagcccgucauccugaaggacgggcccgagcgcgugauccucgccggcccgaugcccgugaccgucgccuccgccgcccagcggcgcgggcggaucggccgcaaccacaacaaggagggcgaccaguacaucuacauggggcagccccugaacaacgacgaggaccacgcgcacuggacggaggccaagaugcugcucgacaacaucaacacccccgagggcaucaucccggcccuguucgagcccgagcgcgagaaguccgccgccaucgacggggaguaccggcugcgcggcgaggcgcggaagaccuucguggagcucaugcgccgcggggaccugcccgucuggcuguccuacaagguggccagcgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcacguacuccgacccgcucgcccugcgggaguucaaggaguucgccgcgggccgccggagcguguccggggaccugauccucgagaucggcaagcugccccagcaccugacccagcgcgcccagaacgcccucgacaaccuggugaugcugcacaacagcgagcagggcgggcgggccuaccgccacgcgauggaggagcuccccgacaccaucgagacccugaugcugcucgcccugaucgccguccugacgggcggggugacccucuucuuccuguccggccgggggcugggcaagaccagcaucggccuccugugcgugauggccuccagcguccugcucuggauggccuccguggagccccacuggaucgcggccagcaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagacgaccaagaaggaccuggggaucggccacgucgcgguggggaaccaccaccacgccgccaugcucgacguggaccugcacccggccuccgccuggacccuguacgcggucgccaccacgaucaucacccccaugaugcgccacaccaucgagaacaccacggccaacaucagccucaccgccaucgccaaccaggcggccauccugaugggccuggacaagggcuggcccaucuccaagauggacaucggggugccccuccuggcccugggcugcuacagccaggugaacccgcucacccugaccgccgcgguccugaugcucguggcccacuacgccaucaucgggcccggccugcaggccaaggccacgcgcgaggcgcagaagcggaccgccgccgggaucaugaagaaccccaccguggacggcaucgucgccaucgaccuggaccccgugguguacgacgccaaguucgagaagcagcucggccagaucaugcugcugauccucugcaccucccagauccugcugaugcgcacgaccugggcgcucugcgagagcaucacccuggccaccgggccgcugacgacccucugggagggcucccccgggaaguucuggaacaccaccaucgccgucagcauggccaacaucuuccggggcuccuaccuggccggcgcggggcuggccuucagccucaugaagucccugggcgggggccgccgggggacgggcgcccagggcgagacccugggggagaaguggaagcgccagcucaaccagcuguccaagagcgaguucaacaccuacaagcgguccggcaucauggagguggaccgcagcgaggccaaggaggggcugaagcggggcgagaccacgaagcacgcggugucccgcgggaccgccaagcugcggugguucgucgagcgcaaccucgugaagcccgagggcaaggugaucgaccugggcugcgggcggggcggguggagcuacuacugcgccggccugaagaaggucaccgaggugaagggguacaccaagggcggccccgggcacgaggagccgauccccauggccacguacggcuggaaccucgugaagcugcacuccgggaaggacgucuucuucaucccgcccgagaagugcgacacccugcucugcgacaucggcgagagcuccccgaaccccaccaucgaggaggggcgcacccugcgggugcugaagaugguggagcccuggcuccgcggcaaccaguucugcaucaagauccugaaccccuacaugccgagcgucguggagacgcuggagcagaugcagcggaagcacggcgggaugcucgugcgcaacccccugucccggaacagcacccacgagauguacugggucuccugcggcaccgggaacaucgugagcgccgugaacaugaccucccgcaugcugcucaaccgcuucaccauggcgcaccggaagcccacguacgagcgcgacgucgaccugggcgccggcacccggcacguggccguggagcccgaggucgccaaccuggacaucaucgggcagcgcaucgagaacaucaagcacgagcacaagagcaccuggcacuacgacgaggacaacccguacaagaccugggccuaccacggcuccuacgaggugaagcccagcggguccgcgagcagcauggugaacggcgucgugaagcuccugacgaagcccugggacgucauccccauggugacccagaucgccaugaccgacaccacgccguucgggcagcagcggguguucaaggagaaggucgacacccgcacccccaaggccaagcggggcaccgcccagaucauggaggugacggccaaguggcuguggggcuuccucucccgcaacaagaagccccggaucugcacccgcgaggaguucacccggaaggugcgcagcaacgcggccaucggggccgucuucguggacgagaaccaguggaacuccgccaaggaggcgguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacacggccgggugggacacccggaucaccgaggacgaccugcagaacgaggcccgcaucaccgacaucauggagcccgagcacgcccuccuggcgaaguccaucuucaagcugacguaccagaacaaggucgugcgcgugcagcggcccgccaagaacggcaccgucauggacgugaucagccgccgggaccagcgcggguccggccaggugggcaccuacgggcucaacaccuucacgaacauggaggcccagcugauccggcagauggagagcgagggcaucuucucccccagcgagcuggagaccccgaaccucgccgagcgcguccuggacuggcuggagaaguacgggguggagcggcucaagcgcauggccaucuccggcgacgacugcguggucaagcccaucgacgaccgguucgcgaccgcccugaccgcccugaacgacauggggaaggugcgcaaggacaucccccagugggagcccagcaagggcuggaacgacuggcagcaggucccguucugcucccaccacuuccaccagcucaucaugaaggacggccgggagaucgucgugcccugccgcaaccaggacgagcugguggggcgggcccgcgucagccagggcgccggguggagccugcgggagacggcgugccucggcaaguccuacgcccagauguggcagcugauguacuuccaccgccgggaccugcgccucgccgccaacgcgaucugcagcgccgugcccguggacuggauccccaccucccggaccaccuggagcauccacgcccaccaccaguggaugacgaccgaggacaugcuguccgucuggaaccgcguguggaucgaggagaacccguggauggaggacaagacccacaucagcuccuggggcgacgugcccuaccugggcaagcgcgaggaccaguggugcggcagccucaucgggcugaccgcccgggccacgugggcgaccaacauccaggucgccaucaaccaggugcgccggcugaucggcaacgagaacuaccucgacuacaugaccuccaugaagcgcuucaagaacgagagcgaccccgagggggcccugugguga

SEQ ID NO: 7990 - RNA, 9879 nt, Artificial Sequence
  derived and/or modified CDS sequence (opt1) from DENV-1__GU131892__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgugcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguuccugcuccugaucauggggcagcugacguggaacgaccucauccgccugugcaucauggucggcgccaacgcgagcgaccgcauggggaugggcaccaccuaccuggcccucauggccaccuucaagaugcggccgauguucgccguggggcugcuguuccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccaccuucucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcgcacccucauccuggcccccacccggguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgggaaccaccaccacgccgccaugcuggacguggaccugcaccccgccuccgccuggacccucuacgcgguggccacgaccaucaucaccccgaugaugcgccacaccaucgagaacacgaccgccaacaucagccugaccgccaucgccaaccaggcggccauccugaugggccucgacaagggcuggcccaucuccaagauggacaucggggucccccugcuggcccucggcugcuacagccaggugaacccccugacccugacggccgcggugcucaugcuggucgcccacuacgccaucaucgggccgggccugcaggccaaggccacccgcgaggcgcagaagcggaccgccgccgggaucaugaagaaccccaccguggacggcaucguggccaucgaccucgaccccgucguguacgacgccaaguucgagaagcagcugggccagaucaugcugcucauccugugcacgucccagauccugcucaugcgcaccaccugggcgcugugcgagagcaucacccuggccacggggccccucaccacccugugggagggcuccccggggaaguucuggaacaccacgaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggccaaggaggggcucaagcggggcgagacgaccaagcacgcggugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgccgugaacaugaccucccgcaugcuccugaaccgcuucacgauggcgcaccggaagcccaccuacgagcgcgacguggaccugggcgccggcacccggcacgucgccguggagcccgagguggccaaccucgacaucaucgggcagcgcaucgagaacaucaagcacgagcacaagagcaccuggcacuacgacgaggacaaccccuacaagacgugggccuaccacggcuccuacgaggucaagccgagcggguccgcgagcagcauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgccaaguggcucuggggcuuccugucccgcaacaagaagccccggaucugcacccgcgaggaguucacccggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgccacgugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccggaucaccgaggacgaccuccagaacgaggcccgcaucacggacaucauggagccggagcacgcccugcuggcgaaguccaucuucaagcucaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcugauccggcagauggagagcgagggcaucuucucccccagcgagcucgagacccccaaccuggccgagcgcgugcuggacuggcucgagaaguacggggucgagcggcugaagcgcauggccaucuccggcgacgacugcguggugaagccgaucgacgaccgguucgcgaccgcccugacggcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgccggguggagccuccgggagaccgcgugccugggcaaguccuacgcccagauguggcagcugauguacuuccaccgccgggaccuccgccuggccgccaacgcgaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccucggcaagcgcgaggaccaguggugcggcagccugaucgggcugacggcccgggccaccugggcgaccaacauccagguggccaucaaccagguccgccggcucaucggcaacgagaacuaccuggacuacaugaccuccaugaagcgcuucaagaacgagagcgaccccgagggggcccugugguga

SEQ ID NO: 7991 - RNA, 9879 nt, Artificial Sequence
  derived and/or modified CDS sequence (opt1) from DENV-1__GU131893__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaugacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggccacgcagaacggccggcugaucaccgccaacccgaucgucaccgacaaggagaagcccgugaacaucgaggcggagccgcccuucggggaguccuacaucgugaucggcgccggcgagaaggcccugaagcucagcugguucaagaagggguccagcaucggcaagauguucgaggccaccgcccgcggggcgcggcgcauggccauccugggcgacacggccugggacuucggguccaucggcggcgucuucaccagcguggggaagcuggugcaccagaucuucggcaccgccuacgggguccucuucuccggcgugagcuggaccaugaagaucgggcugggcgugcugcucacguggcugggccugaacucccgcagcaccucccucagcaugaccugcaucgccgucgggcuggugacccuguaccucggcgugaugguccaggcggacuccgggugcgugaucaacuggaagggccgggagcugaagugcgggagcggcaucuucgugacgaacgagguccacaccuggaccgagcaguacaaguuccaggccgacagcccgaagcgccuguccgccgccaucggcaaggccugggaggagggggugugcggcauccggagcgcgacccgccucgagaacaucauguggaagcagaucuccaacgagcugaaccacauccugcucgagaacgacaugaaguucaccguggucgugggggacguggccggcauccuggcccaggggaagaagaugauccggccccagcccauggaguacaaguacagcuggaaguccuggggcaaggccaagaucaucggcgcggacguccagaacacgaccuucaucaucgacgggcccaacaccccggagugccccgacgaccagcgcgccuggaacaucugggagguggaggacuacggcuucgggaucuucaccacgaacaucuggcugaagcuccgggacagccacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggucgugguggacgagcacugcggcaaccgggggccgucccuccgcaccaccaccgucacgggcaagaucauccacgaguggugcugccggagcugcacccugccgccccugcgcuuccgcggggaggacggcugcugguacgggauggagauccgccccgugaaggagaaggaggagaaccucgugaaguccauggucagcgccggcagcggcgagguggacuccuucagccuggggcugcucugcaucuccaucaugaucgaggaggugaugcggagccgcuggucccggaagaugcugaugaccggcacccuggcggucuuccuccugcugaucauggggcagcucacguggaacgaccugauccgccugugcaucauggugggcgccaacgccagcgaccgcauggggaugggcaccaccuaccucgcccugauggccaccuucaagaugcggccgauguucgcgguggggcuccuguuccgccggcugacgucccgcgagguccugcuccugaccaucgggcugagccucguggccuccguggagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgcguggaagaccauggccaugguccugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgcgggcggcaugcucaucgccugcuacgugaucagcggguccagcgccgaccugucccuggagaaggccgccgaggugagcugggaggaggaggcggagcacuccggcgccagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggcggugcuggacgacggcaucuaccgcaucaugcagcggggccuccuggggcgcucccaggugggcgucgggguguuccaggagaacguguuccacaccauguggcacgucacccggggcgccgugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgcgaucgcccucgacuucaagcccgggacgagcggcucccccaucgugaaccgcgaggggaagaucgucggccuguacggcaacgggguggugaccaccagcggcaccuacgucagcgccaucgcccaggcgaaggccucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggcguccgagauggccgaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcgcacuucaccgaccccagcuccaucgccgcccggggguacaucagcacccgcgucggcaugggggaggccgccgcgaucuucaugaccgccacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgcgaacugccugcggaagaacgggaagcgcgugauccagcugucccggaagaccuucgacacggaguaccagaagaccaagaacaacgacugggacuacgucgugaccaccgacaucagcgagaugggcgccaacuuccgcgccgaccgggugaucgacccgcgccggugccucaagcccgucauccugaaggacgggcccgagcgcgugauccuggccggccccaugccggugacggucgccuccgcggcccagcggcgcgggcggaucggccgcagccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgcggccaucgacggggaguaccggcugcgcggcgaggcccggaagaccuucguggagcugaugcgccgcggggaccuccccgucuggcugagcuacaagguggccagcgagggcuuccaguacuccgaccgccgguggugcuucgacggcgagcgcaacaaccaggugcuggaggagaacauggacgucgagaucuggacgaaggagggggagcggaagaagcuccgcccccgguggcuggacgcccgcaccuacagcgacccccuggcgcuccgggaguucaaggaguucgccgccggccgccgguccgugagcggggaccugauccuggagaucggcaagcucccgcagcaccugacccagcgcgcccagaacgcgcuggacaaccucgugaugcugcacaacuccgagcagggcgggcgggccuaccgccacgccauggaggagcugcccgacaccaucgagacgcucaugcugcuggcccucaucgccguccugaccggcggggugacccuguucuuccucagcggccgggggcugggcaagaccuccaucggccugcucugcgugauggcgagcuccguccugcuguggauggccagcguggagccccacuggaucgccgccuccaucauccucgaguucuuccugauggugcugcucauccccgagccggaccgccagcggacgccccaggacaaccagcuggccuacgucgugaucgggcuccuguucaugauccugacgguggcggccaacgagaugggccugcucgagaccaccaagaaggaccuggggaucggccacgucgccguggggaaccaccaccacgccgccaugcuggacguggaccuccaccccgcgagcgccuggacccuguacgccgucgccacgaccaucaucaccccgaugaugcgccacaccaucgagaacacgaccgccaacaucucccugaccgcgaucgccaaccaggccgccauccucaugggccuggacaagggcuggcccaucagcaagauggacaucggggugccccugcucgcgcugggcugcuacucccaggugaacccccugacccucacggccgccguccugaugcugguggcccacuacgccaucaucgggccgggccuccaggcgaaggccacccgcgaggcccagaagcggaccgccgccgggaucaugaagaaccccaccguggacggcaucgucgcgaucgaccuggaccccgugguguacgacgccaaguucgagaagcagcugggccagaucaugcuccugauccugugcacgagccagauccuccugaugcgcaccaccugggcccugugcgaguccaucacccucgccacggggccccugaccacccugugggagggcagcccggggaaguucuggaacaccacgaucgccgucuccauggcgaacaucuuccggggcagcuaccucgccggcgccgggcuggccuucagccugaugaagucccucggcgggggccgccgggggaccggcgcgcagggcgagacccugggggagaaguggaagcgccagcugaaccagcucagcaaguccgaguucaacaccuacaagcggagcggcaucauggagguggaccgcuccgaggccaaggaggggcugaagcggggcgagacgaccaagcacgccgugagccgcgggaccgccaagcugcggugguucgucgagcgcaaccuggugaagcccgagggcaaggugaucgaccucggcugcgggcggggcgggugguccuacuacugcgccggccugaagaaggucaccgaggugaagggguacacgaagggcggccccgggcacgaggagcccaucccgauggcgaccuacggcuggaaccuggugaagcuccacagcgggaaggacgucuucuucaucccgcccgagaagugcgacacccugcugugcgacaucggcgaguccagccccaacccgaccaucgaggaggggcgcacgcuccgggugcugaagaugguggagcccuggcugcgcggcaaccaguucugcaucaagauccucaaccccuacaugcccuccgucguggagacccuggagcagaugcagcggaagcacggcgggaugcuggugcgcaacccgcucagccggaacuccacccacgagauguacugggucagcugcggcaccgggaacaucguguccgccgugaacaugaccagccgcaugcugcugaaccgcuucacgauggcccaccggaagcccaccuacgagcgcgacgucgaccucggcgccggcacccggcacguggccguggagcccgaggucgcgaaccuggacaucaucgggcagcgcaucgagaacaucaagcacgagcacaaguccaccuggcacuacgacgaggacaaccccuacaagacgugggccuaccacggcagcuacgaggugaagccguccgggagcgccagcuccauggugaacggcgucgugaagcugcucaccaagcccugggacgucauccccauggugacccagaucgccaugaccgacacgacccccuucgggcagcagcggguguucaaggagaaggucgacacccgcaccccgaaggccaagcggggcacggcgcagaucauggaggugaccgccaaguggcuguggggcuuccugagccgcaacaagaagccccggaucugcacccgcgaggaguucacccggaaggugcgcuccaacgccgccaucggggcggucuucguggacgagaaccaguggaacagcgccaaggaggccguggaggacgagcgguucugggaccucguccaccgcgagcgggagcugcacaagcagggcaagugcgccacgugcguguacaacaugauggggaagcgcgagaagaagcugggcgaguucgggaaggccaagggcucccgggcgaucugguacauguggcucggcgcccgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacaccgccgggugggacacccggaucaccgaggacgaccugcagaacgaggcgcgcaucacggacaucauggagccggagcacgcccugcucgccaagagcaucuucaagcugaccuaccagaacaaggucgugcgcgugcagcggcccgccaagaacggcaccgucauggacgugaucucccgccgggaccagcgcgggagcggccaggugggcaccuacgggcugaacacguucaccaacauggaggcccagcucauccggcagauggaguccgagggcaucuucagccccuccgagcuggagacccccaaccuggcggagcgcguccucguguggcuggagaaguacgggguggagcggcugaagcgcauggccaucagcggcgacgacugcgucgugaagccgaucgacgaccgguucgccaccgcccucacggcccugaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcucgucgggcgggcgcgcgugagccagggcgccggguggucccugcgggagaccgccugccugggcaagagcuacgcccagauguggcagcucauguacuuccaccgccgggaccugcgccuggcggccaacgccaucugcuccgccgugcccgucgacuggauccccaccagccggaccacgugguccauccacgcccaccaccaguggaugaccaccgaggacaugcucagcguguggaaccgcguguggaucgaggagaaccccuggauggaggacaagacccacaucuccagcuggggcgacgucccguaccugggcaagcgcgaggaccaguggugcggcucccugaucgggcucacggcgcgggccaccugggccaccaacauccagguggccaucaaccaggugcgccggcugaucggcaacgagaacuaccuggacuacaugaccagcaugaagcgcuucaagaacgaguccgaccccgagggggcccucugguga

SEQ ID NO: 7992 - RNA, 9879 nt, Artificial Sequence
  derived and/or modified CDS sequence (opt1) from DENV-1__GU131894__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcacaaggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggcccggaucacggacaucauggagccggagcacgcgcugcuggccaaguccaucuucaagcucaccuaccagaacaagguggugcgcguccagcgccccgccaagaacggcaccgugauggacgugaucagccggcgcgaccagcggggguccggccaggucggcaccuacgggcugaacacguucaccaacauggaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggacccccaccucccgcacgaccuggagcauccacgcccaccaccaguggaugaccaccgaggacaugcuguccguguggaaccggguguggaucgaggagaaccccuggauggaggacaagacgcacaucagcuccuggggcgacgucccguaccucggcaagcgcgaggaccaguggugcggcagccugaucgggcugaccgcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 7993 - RNA, 9879 nt, Artificial Sequence
  derived and/or modified CDS sequence (opt1) from DENV-1__GU131895__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcuggcgcugaagggcaugagcuacgugaugugcaccggguccuucaagcucgagaaggaggucgccgagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggcggagccgcccuucggggaguccuacaucgucaucggcgccggcgagaaggcccugaagcucagcugguucaagaagggguccagcaucggcaagauguucgaggccaccgcccgcggggcgcggcgcauggccauccugggcgacaccgccugggacuucggguccaucggcggcguguucacgagcguggggaagcugguccaccagaucuucggcaccgccuacgggguccucuucuccggcgugagcuggaccaugaagaucgggaucggcguccugcugaccuggcucggccugaacucccgcagcacgucccugagcaugaccugcaucgccguggggcucgugacccuguaccugggcgucauggugcaggcggacuccgggugcgugaucaacuggaagggccgggagcucaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggcgguguuccugcuccugaucauggggcagcugaccuggaacgaccucauccgccugugcaucauggugggcgccaacgccagcgaccgcauggggaugggcacgaccuaccuggcccucauggccaccuucaagaugcggccgauguucgcggucgggcugcuguuccgccggcucaccucccgcgaggugcugcugcucacgaucgggcugagccugguggccuccgucgagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgcguggaagaccauggccauggugcucagcaucgucucccuguucccccugugccucagcaccacgucccagaagaccaccuggcugcccgugcugcucggcagccuggggugcaagccgcugaccauguuccucaucgccgagaacaagaucuggggccggcgcuccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggacgaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacgcccagcccgcccgagguggagcgggcggugcuggacgacggcaucuaccgcaucaugcagcggggccugcucgggcgcucccaggucggcguggggguguuccaggagaacgucuuccacaccauguggcacgugacccggggcgccgugcugauguaccaggggaagcgccuggagcccagcugggccuccgucaagaaggaccucaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgcgaggggaagaucgugggccucuacggcaacgggguggucacgaccagcggcaccuacgugagcgccaucgcccaggcgaaggccucccaggaggggccgcugcccgagaucgaggacgagguguuccggaagcgcaaccugaccaucauggaccuccaccccggcagcgggaagacgcggcgcuaccugccggccaucguccgggaggccaucaagcgcaagcugcgcacccucauccuggcccccacccgggugguggcguccgagauggccgaggcccugaagggcaugcccauccgcuaccagaccacggccgucaagagcgagcacaccggcaaggagaucguggaccucaugugccacgccaccuucaccaugcggcugcugucccccgugcgcgucccgaacuacaacaugaucaucauggacgaggcgcacuucacggaccccagcuccaucgccgcccggggguacaucagcacccgcgugggcaugggggaggccgccgcgaucuucaugaccgccacgccgcccggcuccguggaggccuucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgcgaacugccuccggaagaacgggaagcgcgucauccagcugucccggaagaccuucgacaccgaguaccagaagacgaagaacaacgacugggacuacguggugaccaccgacaucagcgagaugggcgccaacuuccgcgccgaccgggucaucgacccgcgccggugccugaagcccgugauccucaaggacgggcccgagcgcgugauccuggccggccccaugccggucaccguggccuccgcggcccagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcgcugcgggaguucaaggaguucgccgccggccgccggagcguguccggggaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacccugaugcuccuggcccugaucgccgugcucacgggcggggugacccuguucuuccuguccggccgggggcucggcaagaccagcaucggccugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucgggcugcuguucaugauccucaccgucgcggccaacgagaugggccugcuggagacgaccaagaaggaccucgggaucggccacguggccguggggaaccaccaccacgccgccaugcuggacgucgaccugcaccccgcguccgccuggacccucuacgccguggccaccacgaucaucaccccgaugaugcgccacaccaucgagaacaccacggccaacaucagccugaccgcgaucgccaaccaggccgccauccugaugggccucgacaagggcuggcccaucuccaagauggacaucggggugccccugcuggcgcucggcugcuacagccaggucaacccccugacccugaccgccgccgugcucaugcugguggcccacuacgccaucaucgggccgggccugcaggcgaaggccacgcgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggcgaacaucuuccggggcuccuaccuggccggcgccgggcucgccuucagccugaugaagucccugggcgggggccgccgggggacgggcgcgcagggcgagacccucggggagaaguggaagcgccagcugaaccagcuguccaagagcgaguucaacaccuacaagcgguccggcaucauggagguggaccgcagcgaggccaaggaggggcucaagcggggcgagaccacgaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggcgacguacggcuggaaccuggucaagcugcacuccgggaaggacguguucuucaucccgcccgagaagugcgacacccuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacgcucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgcuucaccauggcccaccggaagcccacguacgagcgcgacguggaccugggcgccggcacccggcacguggccgucgagcccgagguggcgaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugacgaagcccugggacgugauccccauggugacccagaucgccaugaccgacaccacgcccuucgggcagcagcgggucuucaaggagaagguggacacccgcaccccgaaggccaagcggggcaccgcgcagaucauggaggugacggccaaguggcucuggggcuuccugucccgcaacaagaagccccggaucugcacccgcgaggaguucacccggaagguccgcagcaacgccgccaucggggcgguguucguggacgagaaccaguggaacuccgccaaggaggccgucgaggacgagcgguucugggaccuggugcacaaggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacacggccgggugggacacccgcaucaccgaggacgaccuccagaacgaggcgcggaucaccgacaucauggagccggagcacgcccugcuggccaaguccaucuucaagcucacguaccagaacaagguggugcgcguccagcgccccgccaagaacggcaccgugauggacgugaucagccggcgcgaccagcggggguccggccaggucggcaccuacgggcugaacaccuucacgaacauggaggcccagcugauccgccagauggagagcgagggcaucuucucccccagcgagcucgagacccccaaccuggcggagcgggugcuggacuggcucgagaaguacgggguggagcgccugaagcggauggccaucuccggcgacgacugcgucgugaagccgaucgacgaccgcuucgccaccgcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcgcgggugagccagggcgccggguggagccuccgcgagacggccugccugggcaaguccuacgcccagauguggcagcugauguacuuccaccggcgcgaccuccggcuggcggccaacgccaucugcagcgccgugcccgucgacuggauccccaccucccgcaccaccuggagcauccacgcccaccaccaguggaugacgaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugaccgcgcgcgccacgugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 7994 - RNA, 9879 nt, Artificial Sequence
  derived and/or modified CDS sequence (opt1) from DENV-1__GQ868632__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcgugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgagcagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagcgggaggagaaccuggugaaguccauggugagcgccggcagcggcgaggucgacuccuucagccucgggcugcugugcaucuccaucaugaucgaggaggugaugcgcagccgguggucccgcaagaugcucaugaccggcacccuggccguguuccugcuccugaucauggggcagcugacguggaacgaccucauccgccugugcaucauggucggcgcgaacgccagcgaccggauggggaugggcaccaccuaccuggcccucauggccaccuucaagaugcgcccgauguucgccguggggcugcuguuccggcgccucacgucccgggaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccgccgguccuggccccugaacgaggggaucauggccgucggcaucgugagcauccugcucagcuccuuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcgcaagcugcggacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggccuccagcgugcugcucuggauggcguccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggccgcgaacgagaugggccuccuggagaccaccaagaaggaccuggggaucggccacguggccgucgggaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggucccccuccuggcccugggcugcuacagccaggugaacccccucacccugacggcggccgugcugaugcucgucgcccacuacgccaucaucgggccgggccugcaggccaaggcgacccgggaggcccagaagcgcaccgccgccgggaucaugaagaaccccaccguggacggcaucguggccaucgaccuggaccccgucguguacgacgcgaaguucgagaagcagcucggccagaucaugcugcugauccucugcacgucccagauccugcugaugcggaccaccugggcccucugcgagagcaucacccuggccacggggccccugaccacccucugggagggcuccccggggaaguucuggaacaccacgaucgccgugagcauggccaacaucuuccgcggcuccuaccuggcgggcgccgggcuggccuucagccucaugaagucccugggcgggggccggcgcgggaccggcgcccagggcgagacccugggggagaaguggaagcggcagcucaaccagcuguccaagagcgaguucaacaccuacaagcgcuccggcaucauggaggucgaccggagcgaggcgaaggaggggcugaagcgcggcgagacgaccaagcacgccgugucccgggggaccgccaagcuccgcugguucguggagcggaaccuggucaagcccgagggcaaggugaucgaccugggcugcgggcgcggcggguggagcuacuacugcgccggccugaagaaggugaccgaggucaagggguacacgaagggcggccccgggcacgaggagcccaucccgauggccaccuacggcuggaaccucgugaagcugcacuccgggaaggacguguucuucaucccgcccgagaagugcgacacccugcucugcgacaucggcgagagcucccccaacccgaccaucgaggaggggcggacgcugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacccacgagauguacuggguguccugcggcaccgggaacaucgucagcgcggugaacaugaccucccgcaugcugcucaaccgguucacgauggcccaccgcaagcccaccuacgagcgggacguggaccugggcgccggcacccgccacgucgccguggagcccgagguggccaaccuggacaucaucgggcagcggaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcgaaguggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcacaaggagcgggagcugcacaagcagggcaagugcgccacgugcgucuacaacaugauggggaagcgcgagaagaagcucggcgaguucgggaaggccaagggcagccgggccaucugguacauguggcugggcgcgcgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccggaucaccgaggacgaccugcagaacgaggcccgcaucacggacaucauggagccggagcacgcgcuccuggccaaguccaucuucaagcugaccuaccagaacaaggugguccgcgugcagcggcccgccaagaacggcaccgugauggacgucaucagccgccgggaccagcgcggguccggccaggugggcaccuacgggcucaacacguucaccaacauggaggcccagcugauccggcagauggagagcgagggcaucuucucccccagcgagcuggagacccccaaccucgccgagcgcgugcuggacuggcuggagaaguacggggucgagcggcucaagcgcauggcgaucuccggcgacgacugcguggugaagccgaucgacgaccgguucgccaccgcccugacggcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgcgggguggagccugcgggagaccgccugccucggcaaguccuacgcccagauguggcagcugauguacuuccaccgccgggaccugcgccucgccgcgaacgccaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccugggcaagcgcgaggaccaguggugcggcagccucaucgggcugacggcccgggcgaccugggccaccaacauccagguggccaucaaccagguccgccggcugaucggcaacgagaacuaccucgacuacaugaccuccaugaagcgcuucaagaacgagagcgaccccgagggggcccugugguga

SEQ ID NO: 7995 - RNA, 9879 nt, Artificial Sequence
  derived and/or modified CDS sequence (opt1) from DENV-1__GQ868633__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgaggccacgaagcacgccgucucccgcgggcccgccaagcugcggugguucguggagcgcaaccuggugaaccccgagggcaaggucaucgaccugggcugcgggcggggcggguggagcuacuacugcgccggccucaagaaggugaccgaggugaagggguacaccaagggcggccccgggcacgaggagccgauccccauggcgaccuacggcuggaaccuggucaagcugcacuccgggaaggacguguucuucaucccgcccgagaagugcgacacgcuccugugcgacaucggcgagagcuccccgaaccccaccaucgaggaggggcgcacccugcgggugcucaagauggucgagcccuggcugcgcggcaaccaguucugcaucaagauccugaaccccuacaugccgagcgugguggagacccucgagcagaugcagcggaagcacggcgggaugcugguccgcaacccccugucccggaacagcacgcacgagauguacuggguguccugcggcaccgggaacaucgugagcgccgucaacaugaccucccgcaugcuccugaaccgcuucaccauggcccaccggaagcccaccuacgagcgcgacguggaccugggcgccggcacgcggcacguggccgucgagcccgagguggcgaaccucgacaucaucgggcagcgcaucgagaacaucaagcacgagcacaagagcaccuggcacuacgacgaggacaacccguacaagaccugggccuaccacggcuccuacgaggugaagcccagcggguccgccagcagcauggucaacggcguggucaagcugcugaccaagcccugggacgugauccccauggugacgcagaucgccaugaccgacaccaccccguucgggcagcagcgggucuucaaggagaagguggacacgcgcacccccaaggccaagcggggcaccgcgcagaucauggaggugaccgccaaguggcucuggggcuuccugucccgcaacaagaagccccggaucugcacgcgcgaggaguucacccggaagguccgcagcaacgccgccaucggggcgguguucguggacgagaaccaguggaacuccgccaaggaggccgucgaggacgagcgguucugggaccuggugcacaaggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugggucucccgcgagaacagccuguccggcguggagggggagggccuccacaagcugggguacauccugcgggacaucagcaagaucccgggcggcaacauguacgccgacgacaccgccgggugggacacgcgcaucaccgaggacgaccuccagaacgaggcgcggaucaccgacaucauggagcccgagcacgcccugcuggccaaguccaucuucaagcucaccuaccagaacaaggugguccgcgugcagcgccccgccaagaacggcacggugauggacgucaucagccggcgcgaccagcggggguccggccaggugggcaccuacgggcugaacaccuucaccaacauggaggcccagcugauccgccagauggagagcgagggcaucuucucccccagcgagcucgagacgccgaaccuggcggagcgggugcuggacuggcucgagaaguacggggucgagcgccugaagcggauggccaucuccggcgacgacugcguggugaagcccaucgacgaccgcuucgccaccgcccugaccgcccucaacgacauggggaagguccggaaggacaucccccagugggagcccagcaagggcuggaacgacuggcagcaggucccguucuggucccaccacuuccaccagcugaucaugaaggacggccgcgagaucgugguccccugccggaaccaggacgagcugguggggcgcgcgcgggugagccagggcgccggguggagccuccgcgagaccgccugccugggcaaguccuacgcccagauguggcagcugauguacuuccaccggcgcgaccuccggcuggcggccaacgccaucugcagcgccguccccguggacuggauccccacgucccgcaccaccuggagcauccacgcccaccaccaguggaugaccacggaggacaugcuguccguguggaaccgggucuggaucgaggagaacccguggauggaggacaagacccacaucagcuccuggggcgacgugcccuaccucggcaagcgcgaggaccaguggugcggcagccugaucgggcugaccgcgcgcgccaccugggccacgaacauccagguggccaucaaccagguccggcgccucaucggcaacgagaacuaccuggacuacaugaccuccaugaagcgguucaagaacgagagcgaccccgagggggcccugugguga

SEQ ID NO: 7996 - RNA, 9879 nt, Artificial Sequence
  derived and/or modified CDS sequence (opt1) from DENV-1__GU131919__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuuccugacccaggacgagaagggggucacgcagaacggccggcugaucaccgccaacccgaucgugaccgacaaggagaagcccgugaacaucgaggccgagccgcccuucggggagagcuacaucgucaucggcgcgggcgagaaggcccucaagcuguccugguucaagaaggggagcuccaucggcaagauguucgaggccaccgcccgcggggcccggcgcauggcgauccugggcgacacggccugggacuucgggagcaucggcggcguguucaccuccguggggaagcucauccaccagaucuucggcaccgccuacgggguccuguucagcggcguguccuggaccaugaagaucgggaucggcgugcugcucacguggcugggccugaacagccgcuccaccagccucuccaugaccugcaucgccgucgggcuggugacccuguaccucggcgugaugguccaggccgacagcgggugcgugaucaacuggaagggccgggagcugaagugcggguccggcaucuucgugacgaacgagguccacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacacgaccuucaucaucgacgggcccaacaccccggagugccccgacgaccagcgcgcguggaacaucugggagguggaggacuacggcuucgggaucuucaccacgaacaucuggcugaagcuccgggacuccuacacccaggugugcgaccaccgccugaugagcgccgccaucaaggacuccaaggccguccacgccgacaugggcuacuggaucgagagcgagaagaacgagaccuggaagcuggcgcgggccuccuucaucgaggugaagaccugcaucuggcccaagagccacacgcucugguccaacggcgugcuggagagcgagaugaucauccccaagaucuacgggggcccgaucucccagcacaacuaccgccccggguacuucacccagaccgccggccccuggcaccuggggaagcucgagcuggacuucgaccugugcgagggcaccacggucgugguggacgagcacugcggcaaccgggggccgagccuccgcaccaccaccgucacgggcaagaucauccacgaguggugcugccgguccugcacccugccgccccugcgcuuccgcggggaggacggcugcugguacgggauggagauccgccccgugaaggagaaggaggagaaccucgucaagagcauggucuccgccggcagcggcgagguggacagcuucucccuggggcugcucugcaucagcaucaugaucgaggaggugaugcggucccgcuggagccggaagaugcugaugaccggcacccuggccgucuuccuccugcugaucauggggcagcucacguggaacgaccugauccgccugugcaucauggugggcgcgaacgccugcgaccgcauggggaugggcaccaccuaccucgcccugauggccaccuucaagaugcggccgauguucgccguggggcuccuguuccgccggcugacgucccgcgagguccugcuccugaccaucgggcugagccucguggcguccguggagcugcccaacagccuggaggagcucggcgacgggcuggccaugggcaucaugauccugaagcuccugaccgacuuccaguccuaccagcugugggccacccuccugagccugacguucaucaagaccaccuucucccuccacuacgccuggaagaccauggcgaugguccugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccuguccagccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucuccgccaucgcccaggccaaggcgagccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggugacggucgccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacuccgaccgccgguggugcuucgacggcgagcgcaacaaccaggugcuggaggagaacauggacgucgagaucuggacgaaggagggggagcggaagaagcuccgcccccgguggcuggacgcccgcaccuacagcgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccuguucaugauccugacgguggccgcgaacgagaugggccugcucgagaccaccaagaaggaccuggggaucggccacgucgccguggggaaccaccaccacgccgccaugcuggacguggaccuccaccccgccuccgcguggacccuguacgccgucgccacgaccaucaucaccccgaugaugcgccacaccaucgagaacacgaccgccaacaucagccugaccgccaucgcgaaccaggccgccauccucaugggccuggacaagggcuggcccaucuccaagauggacaucggggugccccugcucgcccugggcugcuacagccaggugaacccccugacccucacggcggccguccugaugcugguggcccacuacgccaucaucgggccgggccuccaggccaaggcgacccgcgaggcccagaagcggaccgccgccgggaucaugaagaaccccaccguggacggcaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgucagcauggccaacaucuuccggggcuccuaccucgcgggcgccgggcuggccuucagccugaugaagucccucggcgggggccgccgggggaccggcgcccagggcgagacccugggggagaaguggaagcgccagcugaaccagcucagcaagagcgaguucaacaccuacaagcgguccggcaucauggagguggaccgcagcgaggcgaaggaggggcugaagcggggcgagacgaccaagcacgccgugucccgcgggaccgccaagcugcggugguucgucgagcgcaaccuggugaagcccgagggcaaggugaucgaccucggcugcgggcggggcggguggagcuacuacugcgccggccugaagaaggucaccgaggugaagggguacacgaagggcggccccgggcacgaggagcccaucccgauggccaccuacggcuggaaccuggugaagcuccacuccgggaaggacgucuucuucaucccgcccgagaagugcgacacccugcugugcgacaucggcgagagcucccccaacccgaccaucgaggaggggcgcacgcuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcaccgggaacaucgugagcgcggugaacaugaccucccgcaugcugcugaaccgcuucacgauggcccaccggaagcccaccuacgagcgcgacgucgaccucggcgccggcacccggcacguggccguggagcccgaggucgccaaccuggacaucaucgggcagcgcaucgagaacaucaagcacgagcacaagagcaccuggcacuacgacgaggacaaccccuacaagacgugggcguaccacggcuccuacgaggugaagccgagcggguccgccagcuccauggugaacggcgucgugaagcugcucaccaagcccugggacgucauccccauggugacccagaucgccaugaccgacacgacccccuucgggcagcagcggguguucaaggagaaggucgacacccgcaccccgaaggccaagcggggcacggcccagaucauggaggugaccgcgaaguggcuguggggcuuccugagccgcaacaagaagccccggaucugcacccgcgaggaguucacccggaaggugcgcagcaacgccgccaucggggccgucuucguggacgagaaccaguggaacuccgcgaaggaggccguggaggacgagcgguucugggaccucguccaccgcgagcgggagcugcacaagcagggcaagugcgccacgugcguguacaacaugauggggaagcgcgagaagaagcugggcgaguucgggaaggccaagggcagccgggccaucugguacauguggcucggcgcgcgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcccgcaucacggacaucauggagccggagcacgcgcugcucgccaaguccaucuucaagcugaccuaccagaacaaggucgugcgcgugcagcggcccgccaagaacggcaccgucauggacgugaucagccgccgggaccagcgcggguccggccaggugggcaccuacgggcugaacacguucaccaacauggaggcccagcucauccggcagauggagagcgagggcaucuucucccccagcgagcuggagacccccaaccuggccgagcgcguccucgacuggcuggagaaguacgggguggagcggcugaagcgcauggcgaucuccggcgacgacugcguggucaagccgaucgacgaccgguucgccaccgcccucacggcccugaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcucguggggcgggcccgcgucagccagggcgcgggguggucccugcgggagaccgccugccugggcaagagcuacgcccagauguggcagcucauguacuuccaccgccgggaccugcgccuggccgcgaacgccaucugcagcgccgugcccguggacuggauccccaccucccggaccacguggagcauccacgcccaccaccaguggaugaccaccgaggacaugcucuccgucuggaaccgcguguggaucgaggagaaccccuggauggaggacaagacccacaucagcuccuggggcgacgugccguaccugggcaagcgcgaggaccaguggugcggcagccugaucgggcucacggcccgggcgaccugggccaccaacauccaggucgccaucaaccaggugcgccggcugaucggcaacgagaacuaccuggacuacaugaccuccaugaagcgcuucaagaacgagagcgaccccgagggggcccucugguga

SEQ ID NO: 7997 - RNA, 9879 nt, Artificial Sequence
  derived and/or modified CDS sequence (opt1) from DENV-1__GU131920__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgaccgcgagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccggagcaccucccugagcaugaccugcaucgccguggggcucgugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucaccgucguggugggggacgucgcgggcauccucgcccaggggaagaagaugauccgcccccagcccauggaguacaaguacagcuggaaguccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguuccugcuccugaucauggggcagcugacguggaacgaccucauccgccugugcaucauggugggcgcgaacgccagcgaccggauggggaugggcaccaccuaccuggcccucauggccaccuucaagaugcgcccgauguucgccgucgggcugcuguuccggcgccucacgucccgggaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccgccgguccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacaccauguggcacgugacccgcggcgcggugcugauguaccaggggaagcggcuggagcccagcugggccuccgucaagaaggaccucaucagcuacggcggcggguggcgccugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccucuacggcaacgggguggucaccaccagcggcaccuacgugagcgccaucgcccaggccaaggcgucccaggaggggccgcugcccgagaucgaggacgagguguuccgcaagcggaaccugacgaucauggaccuccaccccggcagcgggaagacccgccgguaccugccggccaucguccgcgaggccaucaagcgccggcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcgcacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcggcacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccgcaacagcacccacgagauguacuggguguccugcggcaccgggaacaucgugagcgcggucaacaugaccucccggaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcacaaggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggcccgcaucacggacaucauggagccggagcacgcgcugcuggccaaguccaucuucaagcucaccuaccagaacaagguggugcggguccagcgccccgccaagaacggcaccgugauggacgugaucagccggcgcgaccagcggggguccggccaggucggcaccuacgggcugaacacguucaccaacauggaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggauccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccucggcaagcgggaggaccaguggugcggcagccugaucgggcugacggcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 7998 - RNA, 9879 nt, Artificial Sequence
  derived and/or modified CDS sequence (opt1) from DENV-1__GU131921__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugauggcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccaugacggagauccagcucaccgacuacggggcccugacccuggacugcagcccccgcaccggccucgacuucaacgagauggugcugcugacgaugaaggagaaguccuggcucguccacaagcagugguuccuggaccugccccuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcguggggaagcugguccaccagaucuucggcgccgccuacgggguccucuucuccggcgugagcuggaccaugaagaucgggaucggcguccugcugaccuggcucggccugaacucccgcagcaccucccugagcaugacgugcaucgccguggggcucgugacccuguaccugggcgucauggugcaggcggacuccgggugcgugaucaacuggaagggccgggagcucaagugcgggagcggcaucuucgucaccaacgaggugcacaccuggacggagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccaccuucaucaucgacgggcccaacacgccggagugccccgacgaccagcgcgccuggaacaucugggagguggaggacuacggcuucgggaucuucaccaccaacaucuggcugaagcugcgggacagcuacacccaggucugcgaccaccgccucauguccgccgccaucaaggacagcaaggccgugcacgcggacaugggcuacuggaucgaguccgagaagaacgagacguggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacccagacggccggccccuggcaccuggggaagcuggagcucgacuucgaccugugcgagggcaccaccgugguggucgacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugacgggcacccuggcgguguuccugcuccugaucauggggcagcugaccuggaacgaccucauccgccugugcaucauggugggcgccaacgccagcgaccgcauggggaugggcaccacguaccuggcccucauggccaccuucaagaugcggccgauguucgcggucgggcugcuguuccgccggcucaccucccgcgaggugcugcugcucaccaucgggcugagccugguggccuccgucgagcuccccaacagccuggaggagcugggcgacgggcucgccaugggcaucaugauccugaagcugcucacggacuuccagucccaccagcugugggccacccugcucagccugaccuucaucaagaccacguucucccugcacuacgcguggaagaccauggccauggugcucagcaucgucucccuguucccccugugccucagcaccaccucccagaagacgaccuggcugcccgugcugcucggcagccuggggugcaagccgcugaccauguuccucaucgccgagaacaagaucuggggccggcgcuccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggaccaugaagaucaaggacgaggagcgggacgacacgcucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagaaggcggugcuggacgacggcaucuaccggaucaugcagcgcggccugcucgggcggucccaggucggcguggggguguuccaggagaacgucuuccacacgauguggcacgugacccgcggcgccgugcugauguaccaggggaagcggcuggagcccagcugggccuccgucaagaaggaccucaucagcuacggcggcggguggcgccugcagggcuccuggaacaccggggaggagguccaggugaucgccgucgagcccggcaagaaccccaagaacgugcagaccgcccccgggacguucaagacccccgagggcgaggugggcgcgaucgcccuggacuucaagcccgggaccagcggcucccccaucgucaaccgggaggggaagaucgugggccucuacggcaacgggguggucaccacgagcggcaccuacgugagcgccaucgcccaggcgaaggccucccaggaggggccgcugcccgagaucgaggacgagguguuccgcaagcggaaccugaccaucauggaccuccaccccggcagcgggaagacccgccgguaccugccggccaucguccgcgaggccaucaagcggaagcugcgcacgcucauccuggcccccacccgcgugguggcguccgagauggccgaggcccugaagggcaugcccauccgguaccagaccaccgccgucaagagcgagcacacgggcaaggagaucguggaccucaugugccacgccaccuucaccaugcgccugcugucccccgugcgggucccgaacuacaacaugaucaucauggacgaggcgcacuucaccgaccccagcuccaucgccgcccgcggguacaucagcacgcgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucaccgacuuccccggcaagacggugugguucgugcccuccaucaagagcggcaacgacaucgcgaacugccuccgcaagaacgggaagcgggucauccagcugucccgcaagaccuucgacaccgaguaccagaagaccaagaacaacgacugggacuacguggugacgaccgacaucagcgagaugggcgccaacuuccgggccgaccgcgucaucgacccgcggcgcugccugaagcccgugauccucaaggacgggcccgagcgggugauccuggccggccccaugccggucaccguggccuccgcggcccagcgccgggggcgcaucggccggaaccacaacaaggagggcgaccaguacaucuacauggggcagccccugaacaacgacgaggaccacgcccacuggaccgaggccaagaugcuccuggacaacaucaacacgcccgagggcaucauccccgcccuguucgagccggagcgcgagaaguccgcggccaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggaccuacuccgacccccuggcgcugcgcgaguucaaggaguucgccgccggccggcgcagcguguccggggaccucauccuggagaucggcaagcugccgcagcaccucacgcagcgggcccagaacgcgcuggacaaccuggucaugcuccacaacagcgagcagggcgggcgcgccuaccggcacgccauggaggagcugcccgacaccaucgagacccugaugcuccuggcccugaucgccgugcucaccggcggggugacgcuguucuuccuguccggccgcgggcucggcaagaccagcaucggccugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucgggcugcuguucaugauccucaccgucgcggccaacgagaugggccugcuggagaccacgaagaaggaccucgggaucggccacguggccguggggaaccaccaccacgccgccaugcuggacgucgaccugcaccccgcguccgccuggacccucuacgccguggccaccaccaucaucacgccgaugaugcggcacaccaucgagaacaccaccgccaacaucagccugacggcgaucgccaaccaggccgccauccugaugggccucgacaagggcuggcccaucuccaagauggacaucggggugccccugcuggcgcucggcugcuacagccaggucaacccccugacccugaccgccgccgugcucaugcugguggcccacuacgccaucaucgggccgggccugcaggcgaaggccacccgcgaggcccagaagcgcacggccgccgggaucaugaagaaccccaccgucgacggcaucguggcgaucgaccucgaccccguggucuacgacgccaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggcgaacaucuuccgcggcuccuaccuggccggcgccgggcucgccuucagccugaugaagucccugggcgggggccggcgcgggaccggcgcgcagggcgagacgcucggggagaaguggaagcggcagcugaaccagcuguccaagagcgaguucaacaccuacaagcgcuccggcaucauggagguggaccggagcgaggccaaggaggggcucaagcgcggcgagaccaccaagcacgccgucucccgggggacggccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggcgaccuacggcuggaaccuggucaagcugcacuccgggaaggacguguucuucaucccgcccgagaagugcgacacgcuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacgcacgagauguacuggguguccugcggcaccgggaacaucgugagcgccgucaacaugaccucccggaugcuccugaaccgcuucaccauggcccaccgcaagcccaccuacgagcgggacguggaccugggcgccggcacgcgccacguggccgucgagcccgagguggcgaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugaccaagcccugggacgugauccccauggugacgcagaucgccaugaccgacaccacccccuucgggcagcagcgcgucuucaaggagaagguggacacgcggaccccgaaggccaagcgcggcaccgcgcagaucauggaggugaccgccaaguggcucuggggcuuccugucccggaacaagaagccccgcaucugcacgcgggaggaguucacccgcaagguccggagcaacgccgccaucggggcgguguucguggacgagaaccaguggaacuccgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacgcgcaucaccgaggacgaccuccagaacgaggcgcggaucaccgacaucauggagccggagcacgcccugcuggccaaguccaucuucaagcucaccuaccagaacaagguggugcgcguccagcgccccgccaagaacggcacggugauggacgugaucagccggcgcgaccagcggggguccggccaggucggcaccuacgggcugaacaccuucaccaacauggaggcccagcugauccgccagauggagagcgagggcaucuucucccccagcgagcucgagacgcccaaccuggcggagcgggugcuggacuggcucgagaaguacgggguggagcgccugaagcggauggccaucuccggcgacgacugcgucgugaagccgaucgacgaccgcuucgccaccgcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcgcgggugagccagggcgccggguggagccuccgcgagaccgccugccugggcaaguccuacgcccagauguggcagcugauguacuuccaccggcgcgaccuccggcuggcggccaacgccaucugcagcgccgugcccgucgacuggauccccacgucccgcaccaccuggagcauccacgcccaccaccaguggaugaccacggaggacaugcuguccguguggaaccggguguggaucgaggagaaccccuggauggaggacaagacccacaucagcuccuggggcgacgucccguaccucggcaagcgcgaggaccaguggugcggcagccugaucgggcugaccgcgcgcgccaccugggccacgaacauccagguggccaucaaccaggugcggcgccucaucggcaacgagaacuaccuggacuacaugaccuccaugaagcgguucaagaacgagagcgaccccgagggggcccugugguga

SEQ ID NO: 7999 - RNA, 9879 nt, Artificial Sequence
  derived and/or modified CDS sequence (opt1) from DENV-1__GQ868635__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugauggcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcgccgccuacgggguccucuucuccggcgugagcuggaccaugaagaucgggaucggcguccugcugaccuggcucggccugaacucccgcagcacgucccugagcaugaccugcaucgccguggggcucgugacccuguaccugggcgucauggugcaggcggacuccgggugcgugaucaacuggaagggccgggagcucaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggcgguguuccugcuccugaucauggggcagcugaccuggaacgaccucauccgccugugcaucauggugggcgccaacgccagcgaccgcauggggaugggcacgaccuaccuggcccucauggccaccuucaagaugcggccgauguucgcggucgggcugcuguuccgccggcucaccucccgcgaggugcugcugcucacgaucgggcugagccugguggccuccgucgagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgcguggaagaccauggccauggugcucagcaucgucucccuguucccccugugccucagcaccacgucccagaagaccaccuggcugcccgugcugcucggcagccuggggugcaagccgcugaccauguuccucaucgccgagaacaagaucuggggccggcgcuccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggacgaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacgcccagcccgcccgagguggagaaggcggugcuggacgacggcaucuaccggaucaugcagcgcggccugcucgggcggucccaggucggcguggggguguuccaggagaacgucuuccacaccauguggcacgugacccgcggcgccgugcugauguaccaggggaagcggcuggagcccagcugggccuccgucaagaaggaccucaucagcuacggcggcggguggcgccugcagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgggaggggaagaucgugggccucuacggcaacgggguggucacgaccagcggcaccuacgugagcgccaucgcccaggcgaaggccucccaggaggggccgcugcccgagaucgaggacgagguguuccgcaagcggaaccugaccaucauggaccuccaccccggcagcgggaagacgcgccgguaccugccggccaucguccgcgaggccaucaagcggaagcugcgcacccucauccuggcccccacccgcgugguggcguccgagauggccgaggcccugaagggcaugcccauccgguaccagaccacggccgucaagagcgagcacaccggcaaggagaucguggaccucaugugccacgccaccuucaccaugcgccugcugucccccgugcgggucccgaacuacaacaugaucaucauggacgaggcgcacuucacggaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgcgaacugccuccgcaagaacgggaagcgggucauccagcugucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccucaaggacgggcccgagcgggugauccuggccggccccaugccggucaccguggccuccgcggcccagcgccgggggcgcaucggccggaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggaccaaggagggggagcgcaagaagcugcggccccgcuggcucgacgcccggacguacuccgacccccuggcgcugcgcgaguucaaggaguucgccgccggccggcgcagcguguccggggaccucauccuggagaucggcaagcugccgcagcaccucacccagcgggcccagaacgcgcuggacaaccuggucaugcuccacaacagcgagcagggcgggcgcgccuaccggcacgccauggaggagcugcccgacaccaucgagacccugaugcuccuggcccugaucgccgugcucacgggcggggugacccuguucuuccuguccggccgcgggcucggcaagaccagcaucggccugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucgggcugcuguucaugauccucaccgucgcggccaacgagaugggccugcuggagacgaccaagaaggaccucgggaucggccacguggccguggggaaccaccaccacgccgccaugcuggacgucgaccugcaccccgcguccgccuggacccucuacgccguggccaccacgaucaucaccccgaugaugcggcacaccaucgagaacaccacggccaacaucagccugaccgcgaucgccaaccaggccgccauccugaugggccucgacaagggcuggcccaucuccaagauggacaucggggugccccugcuggcgcucggcugcuacagccaggucaacccccugacccugaccgccgccgugcucaugcugguggcccacuacgccaucaucgggccgggccugcaggcgaaggccacgcgcgaggcccagaagcgcaccgccgccgggaucaugaagaaccccaccgucgacggcaucguggcgaucgaccucgaccccguggucuacgacgccaaguucgagaagcagcugggccagaucaugcugcucauccugugcaccucccagauccugcucaugcggacgaccugggcccugugcgagagcaucacccuggccaccgggccccucacgacccugugggagggcuccccggggaaguucuggaacaccaccaucgccgugagcauggcgaacaucuuccgcggcuccuaccuggccggcgccgggcucgccuucagccugaugaagucccugggcgggggccggcgcgggacgggcgcgcagggcgagacccucggggagaaguggaagcggcagcugaaccagcuguccaagagcgaguucaacaccuacaagcgcuccggcaucauggagguggaccggagcgaggccaaggaggggcucaagcgcggcgagaccacgaagcacgccgucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggcgacguacggcuggaaccuggucaagcugcacuccgggaaggacguguucuucaucccgcccgagaagugcgacacccuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacgcucgagcagaugcagcgcaagcacggcgggaugcugguccggaacccgcugucccgcaacagcacccacgagauguacuggguguccugcggcaccgggaacaucgugagcgccgucaacaugaccucccggaugcuccugaaccgcuucaccauggcccaccgcaagcccacguacgagcgggacguggaccugggcgccggcacccgccacguggccgucgagcccgagguggcgaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugacgaagcccugggacgugauccccauggugacccagaucgccaugaccgacaccacgcccuucgggcagcagcgcgucuucaaggagaagguggacacccggaccccgaaggccaagcgcggcaccgcgcagaucauggaggugacggccaaguggcucuggggcuuccugucccggaacaagaagccccgcaucugcacccgggaggaguucacccgcaagguccggagcaacgccgccaucggggcgguguucguggacgagaaccaguggaacuccgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacacggccgggugggacacccgcaucaccgaggacgaccuccagaacgaggcgcggaucaccgacaucauggagccggagcacgcccugcuggccaaguccaucuucaagcucacguaccagaacaagguggugcgcguccagcgccccgccaagaacggcaccgugauggacgugaucagccggcgcgaccagcggggguccggccaggucggcaccuacgggcugaacaccuucacgaacauggaggcccagcugauccgccagauggagagcgagggcaucuucucccccagcgagcucgagacccccaaccuggcggagcgggugcuggacuggcucgagaaguacgggguggagcgccugaagcggauggccaucuccggcgacgacugcgucgugaagccgaucgacgaccgcuucgccaccgcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcgcgggugagccagggcgccggguggagccuccgcgagacggccugccugggcaaguccuacgcccagauguggcagcugauguacuuccaccggcgcgaccuccggcuggcggccaacgccaucugcagcgccgugcccgucgacuggauccccaccucccgcaccaccuggagcauccacgcccaccaccaguggaugacgaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugaccgcgcgcgccacgugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8000 - RNA, 9879 nt, Artificial Sequence
  derived and/or modified CDS sequence (opt1) from DENV-1__GQ868636__SS-prME
agcgugaccaugcugcucaugcugaugcccaccgcccuggccuuccaccucaccacccggggcggggagccccacaugaucgugaccaagcaggagcgggggaagucccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacaccugggucaccuacgggaccugcucccagaccggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcucccgcgacuucguggaggggcucagcggcgccaccuggguggacgucgugcuggagcacggguccugcgugaccaccauggccaaggacaagcccacgcuggacaucgagcuccugaagaccgaggucaccaaccccgcggugcugcggaagcucugcaucgaggccaagaucagcaacaccacgaccgacucccgcugccccacccagggcgaggccacccugauggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgugggcauccucgcgcaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuucaagggggaggacggcugcugguacgggauggagauccggcccgucaaggagaaggaggagaaccuggugaaguccauggugagcgccggccucggcgaggucgacagcuucucccuggggcugcucugcaucagcaucaugaucgaggaggugaugcgcucccgguggagccgcaagaugcugauggccggcacccuggccguguuccuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgacccucagccugcaccacgccuggaagaccauggcgaugguccuguccaucgugagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgucggcgugguguccauccugcugagcagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggacgaugaagaucaaggacgaggagcgggacgacacccugaccauccuccugaaggccacccugcucgccaucagcggcguguacccgcuguccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccucauguaccaggggaagcgccuggagcccuccugggccagcgugaagaaggaccugaucuccuacggcggcggguggcggcuccagggcagcuggaacaccggggaggaggugcaggucaucgccguggagcccggcaagaaccccaagaacgugcagacggcccccgggaccuucaagacccccgagggcgaggucggcgccaucgcgcuggacuucaagcccgggaccuccggcagccccaucgugaaccgcgaggggaagaucgugggccuguacggcaacggggucgugacgaccuccggcaccuacgugagcgccaucgcccaggccaaggcgagccaggaggggccgcuccccgagaucgaggacgaggucuuccggaagcgcaaccugaccaucauggaccugcaccccggcuccgggaagacgcggcgcuaccucccggccaucgugcgggaggccaucaagcgcaagcugcggacccugauccucgcccccacccgcguggucgccagcgagauggcggaggcccugaagggcaugcccauccgcuaccagaccacggccgugaaguccgagcacaccggcaaggagaucguggaccugaugugccacgccaccuucaccaugcggcuccugagccccguccgcgugccgaacuacaacaugaucaucauggacgaggcccacuucacggaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgcgaacuuccgcgccgaccgggugaucgacccgcgccggugccugaagcccgugauccugaaggacgggcccgagcgcgucauccucgccggccccaugccggugaccgucgccagcgccgcgcagcggcgcgggcggaucggccgcaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgggagaaguccgccgcgaucgacggggaguaccgccugcgcggcgaggcccggaagaccuucguggagcucaugcgccgcggggaccugcccguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgcggccggccgccgguccgucagcggggaccugauccucgagaucggcaagcugccgcagcaccugacccagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugacgggcggggucacccucuucuuccugagcggccgggggcugggcaagaccuccaucggccuccugugcgugauggccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagacgaccaagaaggaccuggggaucggccacguggccgucgagaaccaccaccacgccaccaugcucgacguggaccugcaccccgccagcgccuggacccuguacgcgguggccacgaccaucaucaccccgaugaugcgccacaccaucgagaacacgaccgccaacaucucccucaccgccaucgccaaccaggcggccauccugauggggcuggacaagggcuggcccaucagcaagauggacaucggcgucccccuccuggcccuggggugcuacucccaggugaacccccucacccugacggccgcggugcugaugcucgucgcccacuacgccaucaucggcccggggcugcaggccaaggccacccgggaggcgcagaagcgcaccgccgccggcaucaugaagaaccccaccguggacgggaucguggccaucgaccuggaccccgucguguacgacgccaaguucgagaagcagcucggccagaucaugcugcugauccucugcacgagccagauccugcugaugcgcaccaccugggcgcucugcgaguccaucacccuggccacgggcccccugaccacccucugggaggggagcccgggcaaguucuggaacaccacgaucgccguguccauggccaacaucuuccgggggagcuaccuggccggcgcgggccuggccuucucccucaugaagucccucgggggcgggcgccgggggaccggggcccagggcgagacccugggcgagaaguggaagcgccagcucaaccagcugagcaaguccgaguucaacaucuacaagcggagcgggaucauggaggucgaccgcuccgaggccaaggagggccugaagcgcggggagaccacgcgccacgcggugagccggggcaccgccaagcugcgcugguucguggagcggaaccucgucaagcccgaggggaaggugaucgaccugggcugcggccgcgggggcugguccuacuacugcgccgggcugaagaaggugaccgaggucaagggcuacaccaagggcgggcccggccacgaggagcccaucccgauggccacguacggguggaaccucgugaagcugcacagcggcaaggacguguucuucacgccgcccgagcggugcgacacccugcucugcgacaucggggaguccagccccaacccgaccaucgaggagggccgcacgcugcggguccugaagaugguggagcccuggcuccgcgggaaccaguucugcaucaagauccugaaccccuacaugcccuccguggucgagacccuggagcagaugcagcggaagcacggcggcaugcucgugcgcaacccgcugagccggaacuccacccacgagauguacugggugagcugcgggaccggcaacaucgucuccgccgugaacaugaccagccgcaugcugcucaaccgcuucacgauggcgcaccggaagcccaccuacgagcgcgacguggaccugggggccggcacccggcacgucgccguggagcccgagguggccaaccuggacaucaucggccagcgcaucgagaacaucaagcacgagcacaaguccaccuggcacuacgacgaggacaaccccuacaagacgugggccuaccacgggagcuacgaggucaagccguccggcagcgcguccagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcccgcuggcuguggggcuuccucagccggaacaagaagccccgcaucugcacccgggaggaguucacccgcaaggugcgguccaacgcggccaucggcgccguguucgucgacgagaaccaguggaacagcgccaaggaggcgguggaggacgagcgcuucugggaccuggugcagaaggagcgggagcugcacaagcaggggaagugcgccacgugcgucuacaacaugaugggcaagcgcgagaagaagcucggggaguucggcaaggccaaggggucccgggccaucugguacauguggcugggcgcccgcuuccuggaguucgaggcgcucggcuucaugaacgaggaccacugguucagccgggagaacucccugagcgggguggagggcgaggggcugcacaagcucggcuacauccugcgcgacaucuccaagauccccgggggcaacauguacgccgacgacaccgccggcugggacacccggaucaccgaggacgaccugcagaacgaggccaagaucacggacaucauggagccggagcacgcccuccuggcgaccagcaucuucaagcugaccuaccagaacaaggugguccgcgugcagcgccccgccaagaacgggaccgugauggacgucaucucccggcgcgaccagcggggcagcggccaggugggcacguacggccucaacaccuucaccaacauggaggcccagcugauccgccagauggaguccgaggggaucuuccugcccagcgagcucgagacccccaaccuggccgagcgggugcuggacuggcucgagaagcacggcgucgagcgccugaagcggauggccaucuccggggacgacugcguggugaagccgaucgacgaccgcuucgcgacggcccugaccgcccucaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcuggugggccgcgcccgggugagccagggggccggcuggucccuccgcgagaccgcgugccugggcaagagcuacgcccagauguggcagcugauguacuuccaccggcgcgaccuccggcuggccgccaacgcgaucugcagcgccguccccguggacugggugcccaccucccgcacgaccuggagcauccacgcccaccaccaguggaugaccaccgaggacaugcuguccgucuggaaccggguguggaucgaggagaaccccuggauggaggacaagacgcacgugagcuccuggggcgacgucccguaccucgggaagcgcgaggaccaguggugcggcagccugaucggccugaccgcccgcgccaccugggcguccaacauccagguggccaucaaccaggugcggcgccucaucgggaacgagaacuaccuggacuacaugaccagcaugaagcgguucaagaacgagggcgaccccgagggggcccugugguga

SEQ ID NO: 8001 - RNA, 9879 nt, Artificial Sequence
  derived and/or modified CDS sequence (opt1) from DENV-1__GU131922__SS-prME
agcgugaucaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacccgcaccgagaccuggaugagcuccgagggcgccuggaagcagauccagcgggucgagaccugggcccuccgccaccccggguucaccgugaucgcccuguuccuggcgcacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggccaaggacaagcccacccuggacaucgagcuccugaagaccgaggucacgaaccccgcgauccugcggaagcucugcaucgaggccaagaucuccaacaccaccaccgacagccgcugcccgacgcagggcgaggccacccugguggaggagcaggacgccaacuucgugugccggcgcaccuucgucgaccggggcugggggaacggcugcgggcuguucggcaaggggucccucaucacgugcgccaaguucaagugcgugacgaagcuggagggcaagaucgugcaguacgagaaccugaaguacagcgucaucgugaccgugcacaccggcgaccagcaccaggucgggaacgaguccaccgagcacggcacgaccgcgaccaucacgccccaggcccccaccacggagauccagcucaccgacuacggggcccugacccuggacugcagcccccgcaccggccucgacuucaacgagauggugcugcugacgaugaaggagaaguccuggcucguccacaagcagugguuccuggaccugccccuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcguggggaagcugguccaccagaucuucggcaccgccuacgggguccucuucuccggcgugagcuggaccaugaagaucgggaucggcguccugcugaccuggcucggccugaacucccgcagcacgucccugagcaugaccugcaucgccguggggcucgugacccuguaccugggcgucauggugcaggccgacuccgggugcgugaucaacuggaagggccgggagcucaagugcgggagcggcaucuucgucaccaacgaggugcacacguggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacaccacguucaucaucgacgggcccaacaccccggagugccccgacgaccagcgcgcguggaacaucugggagguggaggacuacggcuucgggaucuucaccaccaacaucuggcugaagcugcgggacagcuacacgcaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugaccuggaacgaccucauccgccugugcaucauggugggcgcgaacgccagcgaccgcauggggaugggcacgaccuaccuggcccucauggccaccuucaagaugcggccgauguucgccgucgggcugcuguuccgccggcucaccucccgcgaggugcugcugcucacgaucgggcugagccugguggcguccgucgagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgccuggaagaccauggcgauggugcucagcaucgucucccuguucccccugugccucagcaccacgucccagaagaccaccuggcugcccgugcugcucggcagccuggggugcaagccgcugaccauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggacgaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacgcccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgccaucgcgcuggacuucaagcccgggaccagcggcucccccaucgucaaccgcgaggggaagaucgugggccucuacggcaacgggguggucacgaccagcggcaccuacgugagcgccaucgcccaggccaaggcgucccaggaggggccgcugcccgagaucgaggacgagguguuccggaagcgcaaccugaccaucauggaccuccaccccggcagcgggaagacgcggcgcuaccugccggccaucguccgggaggccaucaagcgcaagcugcgcacccucauccuggcccccacccgggugguggccuccgagauggcggaggcccugaagggcaugcccauccgcuaccagaccacggccgucaagagcgagcacaccggcaaggagaucguggaccucaugugccacgccaccuucaccaugcggcugcugucccccgugcgcgucccgaacuacaacaugaucaucauggacgaggcccacuucacggaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgccaacugccuccggaagaacgggaagcgcgucauccagcugucccggaagaccuucgacaccgaguaccagaagacgaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucaccguggccuccgccgcgcagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacccugaugcuccuggcccugaucgccgugcucacgggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucaccgucgccgcgaacgagaugggccugcuggagacgaccaagaaggaccucgggaucggccacguggccguggggaaccaccaccacgccgccaugcuggacgucgaccugcaccccgccuccgcguggacccucuacgccguggccaccacgaucaucaccccgaugaugcgccacaccaucgagaacaccacggccaacaucagccugaccgccaucgcgaaccaggccgccauccugaugggccucgacaagggcuggcccaucuccaagauggacaucggggugccccugcuggcccucggcugcuacagccaggucaacccccugacccugaccgcggccgugcucaugcugguggcccacuacgccaucaucgggccgggccugcaggccaaggcgacgcgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggccaacaucuuccggggcuccuaccuggcgggcgccgggcucgccuucagccugaugaagucccugggcgggggccgccgggggacgggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagaccacgaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggccacguacggcuggaaccuggucaagcugcacuccgggaaggacguguucuucaucccgcccgagaagugcgacacccuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacgcucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucaccauggcccaccggaagcccacguacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagaccugggcguaccacggcuccuacgaggugaagccgagcggguccgccagcagcauggucaacggcguggucaagcugcugacgaagcccugggacgugauccccauggugacccagaucgccaugaccgacaccacgcccuucgggcagcagcgggucuucaaggagaagguggacacccgcaccccgaaggccaagcggggcaccgcccagaucauggaggugacggcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcacaaggagcgcgagcuccacaagcagggcaagugcgcgaccugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacacggccgggugggacacccgcaucaccgaggacgaccuccagaacgaggcccggaucaccgacaucauggagccggagcacgcgcugcuggccaaguccaucuucaagcucacguaccagaacaagguggugcgcguccagcgccccgccaagaacggcaccgugauggacgugaucagccggcgcgaccagcggggguccggccaggucggcaccuacgggcugaacaccuucacgaacauggaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugaccgcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagacggccugccugggcaaguccuacgcccagauguggcagcugauguacuuccaccggcgcgaccuccggcuggccgcgaacgccaucugcagcgccgugcccgucgacuggauccccaccucccgcaccaccuggagcauccacgcccaccaccaguggaugacgaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugaccgcccgcgcgacgugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8002 - RNA, 9879 nt, Artificial Sequence
  derived and/or modified CDS sequence (opt1) from DENV-1__GU131923__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccgucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaaggggaucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggcaagcgguccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggagaacgucuuccacaccauguggcacgugacccgcggcgcggugcugauguaccaggggaagcggcuggagcccagcugggccuccgucaagaaggaccucaucagcuacggcggcggguggcgccugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccucuacggcaacgggguggucaccaccagcggcaccuacgugagcgccaucgcccaggccaaggcgucccaggaggggccgcugcccgagaucgaggacgagguguuccgcaagcggaaccugacgaucauggaccuccaccccggcagcgggaagacccgccgguaccugccggccaucguccgcgaggccaucaagcggaagcugcgcacccucauccuggcccccacccgcgugguggccuccgagauggcggaggcccugaagggcaugcccauccgguaccagacgaccgccgucaagagcgagcacaccggcaaggagaucguggaccucaugugccacgccaccuucacgaugcgccugcugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccuccgcaagaacgggaagcgggucauccagcugucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccucaaggacgggcccgagcgggugauccuggccggccccaugccggucacgguggccuccgccgcgcagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggucaugcuccacaacagcgagcagggcgggcgcgcguaccggcacgccauggaggagcugcccgacaccaucgagacgcugaugcuccuggcccugaucgccgugcucaccggcggggugacccuguucuuccuguccggccgcgggcucggcaagaccagcaucggccugcugugcgucauggccuccagcgugcuccuguggauggcguccguggagccccacuggaucgccgccagcaucauccuggaguucuuccucaugguccugcugauccccgagccggaccggcagcgcacgccccaggacaaccagcucgccuacguggugaucgggcugcuguucaugauccucacggucgccgcgaacgagaugggccugcuggagaccaccaagaaggaccucgggaucggccacgaggccguggggaaccaccaccacgccgccaugcuggacguggaccugcaccccgccuccgcguggacccucuacgccgucgccacgaccaucaucaccccgaugaugcggcacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggugaacccccugacccugacggcggccguccucaugcugguggcccacuacgccaucaucgggccgggccugcaggccaaggcgacccgcgaggcccagaagcgcaccgccgccgggaucaugaagaaccccaccguggacggcaucgucgccaucgaccucgaccccgugguguacgacgcgaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgucagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcuguccaagagcgaguucaacaccuacaagcgcuccggcaucauggagguggaccggagcgaggcgaaggaggggcucaagcgcggcgagacgaccaagcacgccgugucccgggggaccgccaagcugcgcugguucgucgagcggaaccuggugaagcccgagggcaaggugaucgaccugggcugcgggcgcggcggguggagcuacuacugcgccggccucaagaaggucaccgaggugaagggguacacgaagggcggccccgggcacgaggagcccaucccgauggccaccuacggcuggaaccuggugaagcugcacuccgggaaggacgucuucuucaucccgcccgagaagugcgacacccuccugugcgacaucggcgagagcucccccaacccgaccaucgaggaggggcggacgcugcgcgugcucaagaugguggagcccuggcugcggggcaaccaguucugcaucaagauccugaaccccuacaugcccagcgucguggagacccucgagcagaugcagcgcaagcacggcgggaugcuggugcggaacccgcugucccgcaacagcacccacgagauguacugggucuccugcggcaccgggaacaucgugagcgcggugaacaugaccucccggaugcuccugaaccgcuucacgauggcccaccgcaagcccaccuacgagcgggacgucgaccugggcgccggcacccgccacguggccguggagcccgaggucgccaaccucgacaucaucgggcagcggaucgagaacaucaagcacgagcacaagagcaccuggcacuacgacgaggacaaccccuacaagacgugggcguaccacggcuccuacgaggugaagccgagcggguccgccagcagcauggugaacggcgucgugaagcugcugaccaagcccugggacgucauccccauggugacccagaucgccaugaccgacacgacccccuucgggcagcagcgcguguucaaggagaaggucgacacccggaccccgaaggccaagcgcggcacggcccagaucauggaggugaccgcgaaguggcucuggggcuuccugucccggaacaagaagccccgcaucugcacccgggaggaguucacccgcaaggugcggagcaacgccgccaucggggccgucuucguggacgagaaccaguggaacuccgcgaaggaggccguggaggacgagcgcuucugggaccugguccaccgggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggcccggaucacggacaucauggagccggagcacgcgcugcuggccaaguccaucuucaagcucaccuaccagaacaaggucgugcgcgugcagcgccccgccaagaacggcaccgucauggacgugaucagccggcgcgaccagcggggguccggccaggugggcaccuacgggcugaacacguucaccaacauggaggcccagcugauccgccagauggagagcgagggcaucuucucccccagcgagcucgagacccccaaccuggccgagcggguccuggacuggcucgagaaguacgggguggagcgccugaagcggauggcgaucuccggcgacgacugcguggucaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucgucgugccgugccggaaccaggacgagcugguggggcgcgcccgggucagccagggcgcgggguggagccuccgcgagaccgccugccugggcaaguccuacgcccagauguggcagcugauguacuuccaccggcgcgaccuccggcuggccgcgaacgccaucugcagcgccgugcccguggacuggauccccaccucccgcaccacguggagcauccacgcccaccaccaguggaugaccaccgaggacaugcuguccgucuggaaccggguguggaucgaggagaaccccuggauggaggacaagacccacaucagcuccuggggcgacgugccguaccucggcaagcgcgaggaccaguggugcggcagccugaucgggcugacggcccgcgcgaccugggccaccaacauccaggucgccaucaaccaggugcggcgccucaucggcaacgagaacuaccuggacuacaugaccuccaugaagcgguucaagaacgagagcgaccccgagggggcccugugguga

SEQ ID NO: 8003 - RNA, 9879 nt, Artificial Sequence
  derived and/or modified CDS sequence (opt1) from DENV-1__GQ868637__SS-prME
agcgugaccaugcugcugaugcugaugcccaccgcccuggccuuccaccucaccacccgcggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccaccgacaccugggugaccuacgggaccugcagccagacgggcgagcaccggcgcgacaagcgguccguggcccucgcgccccacgucggccuggggcuggagacccgcgccgagaccuggaugagcuccgagggcgcguggaagcagauccagcggguggagaccugggcccuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccggcaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccgccucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccggcgcauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgggagcucaagugcgggagcggcaucuucgugaccaacgagguccacacguggaccgagcaguacaaguuccaggccgacuccccgaagcgccugagcgcggccaucggcaaggccugggaggagggggugugcggcauccgguccgccacccgccuggagaacaucauguggcggcagaucagcaacgagcucaaccacauccugcuggagaacgacaugaaguucaccguggucgugggggacguggucggcauccucgcccaggggaagaagaugauccgcccccagcccauggagcacaaguacuccuggaaguccuggggcaaggcgaagaucaucggcgccgacgugcagaacaccacguucaucaucgacgggcccaacaccccggagugccccgacgaccagcgggccuggaacaucugggagguggaggacuacggcuucgggaucuucaccaccaacaucuggcugaagcugcgcgacuccuacacgcaggucugcgaccaccggcucaugagcgccgcgaucaaggacuccaaggccgugcacgccgacaugggcuacuggaucgagagcgagaagaacgagaccuggaagcuggcccgcgccuccuucaucgaggugaagaccugcaucuggcccaagagccacacccugugguccaacggcguccucgagagcgagaugaucauccccaagaucuacgggggcccgaucucccagcacaacuaccggcccggguacuucacgcagaccgcgggccccuggcaccuggggaagcuggagcucgacuucgaccugugcgagggcaccaccgugguggucgacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgugaaggagcgggaggagaaccuggucaagagcauggugagcgccggcuccggcgagguggacagcuucucccucgggcugcugugcaucagcaucaugaucgaggaggucaugcgcucccgguggagccgcaagaugcucaugaccggcacccuggccguguucuuccugcucaucauggggcagcugaccuggaacgaccugauccgccucugcaucauggugggcgccaacgccuccgaccggauggggaugggcacgaccuaccuggcgcugauggccaccuucaagaugcgcccgauguucgccgucggccuccuguuccggcgccugaccagccgggaggugcuccugcugacgaucgggcucucccuggucgccagcguggagcugcccaacucccucgaggagcugggcgacgggcuggccaugggcaucaugauccucaagcugcugaccgacuuccagagccaccagcucugggcgacccugcugucccucaccuucaucaagacgaccuucagccugcacuacgccuggaagaccauggccauggugcuguccaucgucagccuccugccccugugccucuccaccacgagccagaagaccaccuggcugcccgugcugcucggcucccuggggugcaagccgcugaccauguuccucaucgccgagaacaagaucuggggccgcaagagcuggccccugaacgaggggaucauggcggugggcaucgucagcauccugcucuccagccugcugaagaacgacgugccccucgccgggccccugaucgccggcggcaugcugaucgccugcuacgugaucuccgggagcuccgccgaccucagccuggagaaggcggccgaggucuccugggaggaggaggccgagcacagcggcgccucccacaacauccugguggaggugcaggacgacgggacgaugaagaucaaggacgaggagcgggacgacacccucaccauccugcugaaggccacccuccuggcggucagcggcguguacccgcuguccauccccgccacccucuucgugugguacuucuggcagaagaagaagcagcgcagcgggguccugugggacacgcccagcccgcccgagguggagcgggccgugcuggacgacggcaucuaccgcaucaugcagcggggccugcucgggcgcagccaggucggcguggggguguuccaggagaacgucuuccacaccauguggcacgugacccggggcgccgugcugauguaccaggggaagcgccuggagcccuccugggccagcgucaagaaggaccucaucuccuacggcggcggguggcggcugcagggcagcuggaacaccggggaggagguccaggugaucgcggucgagcccggcaagaaccccaagaacgugcagacggcccccgggaccuucaagacccccgagggcgaggugggcgccaucgcccuggacuucaagcccgggaccuccggcagccccaucgucaaccgcgaggggaagaucgugggccucuacggcaacgggguggucacgaccagcggcaccuacguguccgccaucgcgcaggccaaggccagccaggaggggccgcugcccgagaucgaggacgagguguuccggaagcgcaaccugaccaucauggaccuccaccccggcuccgggaagacgcggcgcuaccugccggccaucguccgggaggcgaucaagcgcaagcugcgcacccucauccuggcccccacccgggugguggccagcgagauggccgaggcccugaagggcaugcccauccgcuaccagaccacggcggucaaguccgagcacaccggccgggagaucguggaccucaugugccacgccaccuucaccaugcgccugcugagccccgugcgggucccgaacuacaacaugaucaucauggacgaggcccacuucacggaccccuccagcaucgccgcccgcggguacaucuccacccgggugggcaugggggaggcggccgccaucuucaugaccgccacgccgcccggcagcguggaggccuucccgcaguccaacgcggucauccaggacgaggagcgcgacauccccgagcggagcuggaacuccggguacgaguggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccgcggcgcugccugaagcccgugauccucaaggacgggcccgagcgggucauccuggcgggccccaugccggugaccguggccagcgccgcccagcgccgggggcgcaucggccgcaaccacaacaaggagggcgaccaguacaucuacauggggcagccccugaacaacgacgaggaccacgcccacuggacggaggcgaagaugcuccuggacaacaucaacacccccgagggcaucauccccgcccuguucgagccggagcgggagaaguccgccgccaucgacggggaguaccgccuccggggcgaggcccgcaagaccuucgucgagcugaugcggcgcggggaccugcccguguggcucagcuacaagguggcgagcgagggcuuccaguacuccgaccggcgcuggugcuucgacggcgagcggaacaaccagguccuggaggagaacauggacguggagaucuggaccaaggagggggagcgcaagaagcugcggccccgcuggcucgacgcccggacguacagcgacccccuggcccugcgcgaguucaaggaguucgccgccggccggcgcuccgugagcggggaccucauccuggagaucggcaagcugccgcagcaccucacccagcgggcgcagaacgcccuggacaaccuggucaugcuccacaacuccgagcagggcgggcgcgccuaccggcacgccauggaggagcugcccgacaccaucgagacccugaugcuccuggcgcugaucgccgugcucacgggcggggugacccuguucuuccugagcggccgcgggcucggcaagaccuccaucggccugcugugcgucauggccagcuccgcccuccuguggauggccagcguggagccccacuggaucgcggccuccaucauccuggaguucuuccucauggugcugcugauccccgagccggaccggcagcgcacgccccaggacaaccagcucgccuacgucgugaucgggcugcuguucaugauccucaccguggccgccaacgagaugggccugcuggagacgaccaagaaggaccucgggaucggccacgucgcgguggagaaccaccaccacgccaccaugcuggacguggaccugcaccccgccagcgccuggacccucuacgccgucgcgacgaccaucaucaccccgaugaugcgccacaccaucgagaacacgaccgccaacaucucccugaccgccaucgccaaccaggccgcgauccugauggggcucgacaagggcuggcccaucagcaagauggacaucggcgugccccugcuggcccucgggugcuacucccaggugaacccccugacccugaucgccgccguccucaugcugguggcgcacuacgccaucaucggcccggggcugcaggccaaggccacgcgggaggcccagaagcgcaccgcggccggcaucaugaagaaccccaccguggacgggaucgucgccaucgaccucgaccccgugguguacgacgccaaguucgagaagcagcugggccagaucaugcugcucauccugugcaccagccagauccugcucaugcggacgaccugggcccugugcgaguccaucacccuggcgaccggcccccucacgacccugugggaggggagcccgggcaaguucuggaacaccaccaucgccgucuccauggccaacaucuuccgcgggagcuaccuggccggcgccggccucgcguucagccugaugaagucccucgggggcgggcggcgcgggacgggggcccagggcgagacccucggcgagaaguggaagcggcagcugaaccagcugagcaaguccgaguucaacaccuacaagcgcagcgggaucauggagguggaccgguccgaggccaaggagggccuccgccgcggggagaccacgaagcacgccgugagccgcggcaccgcgaagcugcggugguucgucgagcgcaaccuggugaagcccgaggggaaggugaucgaccugggcugcggccgcggcgggugguccuacuacugcgccgggcucaagaaggucaccgaggugaagggguacaccaagggcgggcccggccacgaggagcccaucccgauggccacguacggguggaaccuggugaagcugcacagcggcaaggacgucuucuucaucccgcccgagaagugcgacacccuccugugcgacaucggggaguccagccccaacccgaccaucgaggagggccgcacccugcgggugcucaagaugguggagcccuggcugcgcgggaaccaguucugcaucaagauccugaaccccuacaugcccuccgucguggagacgcucgagcagaugcagcggaagcacggcggcaugcuggugcgcaacccgcugagccgcaacuccacccacgagauguacugggucagcugcgggaccggcaacaucguguccgccgugaacaugaccagccggaugcuccugaaccgcuucaccauggcccaccggaagcccacguacgagcgcgacgucgaccugggggcgggcacccggcacguggccguggagcccgaggucgccaaccucgacaucaucggccagcgcaucgagaacaucaagcacgagcacaaguccaccuggcacuacgacgaggacaaccccuacaagaccugggccuaccacgggagcuacgaggugaagccguccggcagcgccagcuccauggucaacgggguggugaagcugcugacgaagcccugggacgucauccccauggugacccagaucgcgaugaccgacaccacgcccuucggccagcagcggguguucaaggagaaggucgacacccgcaccccgaaggccaagcgggggaccgcccagaucauggaggugacggcccgcuggcucuggggcuuccugagccggaacaagaagccccgcaucugcacccgggaggaguucacccgcaaggugcgguccaacgccgcgaucggcgccgucuucguggacgagaaccaguggaacagcgccaaggaggccguggaggacgagcgcuucugggaccugguccaccgggagcgcgagcuccacaagcaggggaagugcgcgaccugcguguacaacaugaugggcaagcgggagaagaagcugggggaguucggcaaggccaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgcgacaucuccaagauccccgggggcaacauguacgcggacgacacggccggcugggacacccggaucaccgaggacgaccuccagaacgaggccaagaucaccgacaucauggagccggagcacgcccugcuggccacgagcaucuucaagcucaccuaccagaacaaggucgugcgcgugcagcggcccgcgaagaacgggaccgucauggacgugaucucccgccgggaccagcgcggcagcggccaggugggcaccuacggccugaacacguucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgccaccgcgcugacggcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucagccagggggccggcuggucccuccgggagaccgccugccugggcaagagcuacgcgcagauguggcagcugauguacuuccaccgccgggaccuccgccuggccgccaacgccaucugcuccgcggugcccguggacuggguccccaccagccgcaccacgugguccauccacgcccaccaccaguggaugaccaccgaggacaugcugagcguguggaaccggguguggaucgacgagaaccccuggauggaggacaagacccacaucuccagcuggggcgacgucccguaccucgggaagcgcgaggaccaguggugcggcucccugaucggccugacggcccgggccaccugggccaccaacauccagguggcgaucaaccaggugcgccggcucaucgggaacgagaacuaccuggacuacaugaccagcaugaagcgcuucaagaacgaguccgaccccgagggcgcccugugguga

SEQ ID NO: 8004 - RNA, 9879 nt, Artificial Sequence
  derived and/or modified CDS sequence (opt1) from DENV-1__GQ868639__SS-prME
agcgugaccaugcugcucaugcugaugcccaccgcgcuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccggaucagcgaggccgagcccgacgacguggacugcuggugcaacgccaccgacaccugggucacguacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccuggccgacuuccagucccaccagcugugggccacccuccugagccugacguucaucaagaccaccuucucccuccacuacgcguggaagaccauggccaugguccugagcaucgugucccuguucccccucugccugagcacgaccucccagaagaccaccuggcugcccgugcuccugggcagccuggggugcaagccgcucacgauguuccugaucgccgagaacaagaucuggggccgcaagagcuggccccugaacgaggggaucauggccgucggcaucguguccauccuccugagcucccugcucaagaacgacgugccccuggccgggccccugaucgcgggcggcaugcucaucgccugcuacgucaucagcggguccagcgccgaccugucccuggagaaggccgccgaggugagcugggaggaggaggcggagcacuccggcgccagccacaacauccucguggagguccaggacgacgggaccaugaagaucaaggacgaggagcgggacgacacccugaccauccugcucaaggccacgcugcuggccguguccggcguguacccgcucagcauccccgccacccuguucgucugguacuucuggcagaagaagaagcagcgcuccggggugcugugggacacccccagcccgcccgagguggagcgggcgguccucgacgacggcaucuaccgcaucaugcagcggggccugcuggggcgcucccaggugggcgugggggucuuccaggagaacguguuccacaccauguggcacgugacccggggcgccguccugauguaccaggggaagcgccucgagcccagcugggccuccgugaagaaggaccugaucagcuacggcggcggguggcggcugcagggcuccuggaacacgggggaggaggugcaggucaucgccguggagcccggcaagaaccccaagaacgugcagaccgcccccgggaccuucaagaccagcgagggcgaggucggcgcgaucgcccucgacuucaagcccgggacgagcggcucccccaucgugaaccgcgaggggaagaucgugggccuguacggcaacggggucgugaccaccagcggcaccuacguguccgccaucgcccaggcgaaggccagccaggaggggccccugccggagaucgaggacgaggucuuccggaagcgcaaccucacgaucauggaccugcaccccggcuccgggaagacccggcgcuaccugcccgccaucgugcgggaggccaucaagcgcaagcuccggacccugauccuggccccgacccgcguggucgcgagcgagauggccgaggcccucaagggcaugcccauccgcuaccagacgaccgccgugaaguccgagcacaccggcaaggagaucguggaccugaugugccacgccaccuucacgaugcggcugcucagccccguccgcgugcccaacuacaacaugaucaucauggacgaggcgcacuucaccgacccguccagcaucgccgcccggggguacaucuccacccgcgugggcaugggggaggccgccgcgaucuucaugaccgccacgccgcccggcagcgccgaggccuucccccaguccaacgcggucauccaggacgaggagcgggacaucccggagcgcagcuggaacuccggguacgaguggaucaccgacuuccccggcaagaccgugugguucgugcccagcaucaaguccggcaacgacaucgccaacugccugcggaagaacgggaagcgcgucauccagcugagccggaagaccuucgacacggaguaccagaagaccaagaacaacgacugggacuacguggugaccaccgacaucuccgagaugggcgccaacuuccgcgccgaccgggucaucgacccccgccggugccucaagccggugauccugaaggacgggcccgagcgcgugauccuggccggccccaugcccgucacgguggcgagcgccgcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgccaucgacggggaguaccgccugcgcggcgaggcccggaagaccuucgucgagcugaugcgccgcggggaccucccgguguggcuguccuacaagguggccagcgagggcuuccaguacuccgaccgccgguggugcuucgacggcgagcgcaacaaccagguccuggaggagaacauggacguggagaucuggacgaaggagggggagcggaagaagcuccgcccccgguggcuggacgcgcgcaccuacagcgacccccuggcccuccgggaguucaaggaguucgccgccggccgccgguccgugagcggggaccugauccuggagaucggcaagcucccccagcaccugacccagcgcgcgcagaacgcccuggacaaccucgucaugcugcacaacuccgagcagggcgggcgggccuaccgccacgccauggaggagcugccggacaccaucgagacgcucaugcugcuggcccucaucgcggugcugaccggcggggugacccuguucuuccucagcggccgggggcugggcaagaccuccaucggccugcucugcgucauggccagcuccgugcugcuguggauggccagcguggagccccacuggaucgccgccuccaucauccucgaguucuuccugaugguccugcucauccccgagcccgaccgccagcggacgccgcaggacaaccagcuggcguacguggugaucgggcuccucuucaugauccugaccgucgccgccaacgagaugggccugcucgagaccaccaagaaggaccuggggaucggccacguggccguggagaaccaccaccacgccgcgaugcuggacgucgaccuccaccccgccagcgccuggacccuguacgccguggccacgaccaucaucacccccaugaugcgccacaccaucgagaacacgaccgcgaacaucucccugaccgccaucgccaaccaggccgcgauccucauggggcuggacaagggcuggccgaucagcaagauggacaucggcgugccccugcucgcccuggggugcuacucccaggucaacccccugacccucacggccgccgugcugaugcugguggcccacuacgcgaucaucggccccgggcuccaggccaaggccacccgggaggcccagaagcgcaccgccgcgggcaucaugaagaacccgaccgucgacgggaucguggccaucgaccuggaccccguggucuacgacgccaaguucgagaagcagcugggccagaucaugcuccugauccugugcacgagccagauccuccugaugcgcaccaccugggcccugugcgaguccaucacccucgccacgggcccccugaccacccugugggaggggagccccggcaaguucuggaacaccacgaucgcggugagcauggccaacaucuuccggggguccuaccucgccggcgccggccuggcguucagccugaugaagucccucgggggcgggcgccggggcaccggggcccagggcgagacccugggcgagaaguggaagcgccagcugaaccagcucagcaaguccgaguucaacaccuacaagcggagcgggaucauggagguggaccgcuccgaggccaaggagggccugaagcgcggggagacgaccaagcacgccgucagccgcggcaccgccaagcugcggugguucguggagcgcaaccucgugaagccggaggggaaggucaucgaccugggcugcggccgcggcgggugguccuacuacugcgcggggcugaagaaggugaccgaggugaagggguacacgaagggcgggcccggccacgaggagcccauccccauggccaccuacggguggaaccuggucaagcuccacagcggcaaggacguguucuucgugccgcccgagaagugcgacacccugcugugcgacaucggggaguccagccccaaccccaccaucgaggagggccgcacgcuccggguccugaagaugguggagccguggcugcgcgggaaccaguucugcaucaagauccucaaccccuacaugcccuccguggucgagacccuggagcagaugcagcggaagcacggcggcaugcuggugcgcaacccccucagccggaacuccacccacgagauguacugggugagcugcgggaccggcaacaucgucuccgccgugaacaugacgagccgcaugcugcugaaccgguucaccauggcccaccgcaagccgaccuacgagcgcgacguggaccucggggccggcacccggcacgucgcgguggagcccgagguggccaaccuggacaucaucggccagcgcaucgagaacaucaagcacgagcacaaguccaccuggcacuacgacgaggacaaccccuacaagacgugggccuaccacgggagcuacgaggucaagcccagcggcuccgccagcuccauggugaacggggucgugaagcugcucaccaagccgugggacgugauccccauggucacccagaucgccaugaccgacacgacccccuucggccagcagcggguguucaaggagaagguggacacccgcacccccaaggcgaagcgggggacggcccagaucauggaggucaccgccaaguggcuguggggcuuccugagccgcaacaagaagccgcggaucugcacccgcgaggaguucacccggaaggugcgcuccaacgccgcgaucggcgccguguucgucgacgagaaccaguggaacagcgccaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggcgaaggggucccgggccaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgcgggcugggacacccggaucaccgaggacgaccugcagaacgaggccaagaucacggacaucauggagcccgagcacgcccugcucgccaaguccaucuucaagcugaccuaccagaacaaggugguccgcgugcagcggcccgccaagaacgggaccgugauggacgucaucagccgccgcgaccagcggggcuccggccaggugggcaccuacggccugaacacguucaccaacauggaggcgcagcucauccgccagauggagagcgaggggaucuucuccccgagcgagcuggagacccccaaccuggccgagcgggcccucgacuggcuggagaagcacggcguggagcgccugaagcggauggccaucagcggggacgacugcgucgugaagcccaucgacgaccgcuucgccaccgcgcucacggcccugaacgacaugggcaaggugcggaaggacaucccccagugggagccguccaagggguggaacgacuggcagcagguccccuucugcagccaccacuuccaccagcugaucaugaaggacggccgcgagaucguggugcccugccggaaccaggacgagcucgucggccgcgcccgggugucccagggggccggcuggagccugcgcgagaccgcgugccuggggaaguccuacgcccagauguggcagcucauguacuuccaccggcgcgaccugcggcuggccgccaacgccaucugcagcgcggugcccgucgacugggugccgaccucccgcaccacguggagcauccacgcccaccaccaguggaugaccaccgaggacaugcucuccguguggaaccgggucuggaucgaggagaaccccuggauggaggacaagacccacaucagcuccugggaggacgugcccuaccugggcaagcgcgaggaccaguggugcgggagccugaucggccucacggcccgggccaccugggccaccaacauccagguggcgaucaaccagguccgccgccugaucggcaacgagaacuaccuggacuacaugaccuccaugaagcgguucaagaacgagagcgaccccgagggggcccucugguga

SEQ ID NO: 8005 - RNA, 9879 nt, Artificial Sequence
  derived and/or modified CDS sequence (opt1) from DENV-1__GU131925__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcaccgcgagcgggagcuccacaagcagggcaagugcgccacgugcguguacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacaccgccgggugggacacccggaucaccgaggacgaccuccagaacgaggcccgcaucacggacaucauggagccggagcacgcgcugcuggccaaguccaucuucaagcucaccuaccagaacaagguggugcgcguccagcggcccgccaagaacggcaccgugauggacgugaucagccgccgggaccagcgcggguccggccaggucggcaccuacgggcugaacacguucaccaacauggaggcccagcugauccggcagauggagagcgagggcaucuucucccccagcgagcucgagacccccaaccuggccgagcgcgugcuggacuggcucgagaaguacgggguggagcggcugaagcgcauggcgaucuccggcgacgacugcgucgugaagccgaucgacgaccgguucgccaccgcccugacggcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcccgcgugagccagggcgcgggguggagccuccgggagaccgccugccugggcaaguccuacgcccagauguggcagcugauguacuuccaccgccgggaccuccgccuggccgcgaacgccaucugcagcgccgugcccgucgacuggauccccaccucccggaccacguggagcauccacgcccaccaccaguggaugaccaccgaggacaugcuguccguguggaaccgcguguggaucgaggagaaccccuggauggaggacaagacccacaucagcuccuggggcgacgucccguaccucggcaagcgcgaggaccaguggugcggcagccugaucgggcugacggcccgggcgaccugggccaccaacauccagguggccaucaaccaggugcgccggcucaucggcaacgagaacuaccuggacuacaugaccuccaugaagcgcuucaagaacgagagcgaccccgagggggcccugugguga

SEQ ID NO: 8006 - RNA, 9879 nt, Artificial Sequence
  derived and/or modified CDS sequence (opt1) from DENV-1__GU131926__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggcgugaacucccgcagcaccucccucagcaugacgugcaucgccgucgggcuggugacccuguaccucggcgugaugguccaggccgacagcgggugcgugaucaacuggaagggccgggagcugaagugcggguccggcaucuucgugaccaacgagguccacaccuggacggagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccguggucgugggggacguggcgggcauccuggcccaggggaagaagaugauccggccccagcccauggaguacaaguacagcuggaaguccuggggcaaggccaagaucaucggcgccgacguccagaacaccaccuucaucaucgacgggcccaacacgccggagugccccgacgaccagcgcgcguggaacaucugggagguggaggacuacggcuucgggaucuucaccaccaacaucuggcugaagcuccgggacagcuacacccaggugugcgaccaccgccugauguccgccgccaucaaggacagcaaggccguccacgccgacaugggcuacuggaucgaguccgagaagaacgagacguggaagcuggcgcgggccagcuucaucgaggugaagaccugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgucgugguggacgagcacugcggcaaccgggggccgucccuccgcaccacgaccgucaccggcaagaucauccacgaguggugcugccggagcugcacccugccgccccugcgcuucaagggggaggacggcugcugguacgggauggagauccggcccgugaaggagaaggaggagaaccucgucaagagcauggucuccgccggcagcggcgagguggacuccuucagccuggggcugcucugcaucuccaucaugaucgaggaggugaugcgcagccgguggucccgcaagaugcugaugacgggcacccuggccgucuucuuccuccugaucauggggcagcugaccuggaacgaccucauccggcugugcaucauggugggcgcgaacgccagcgaccgcauggggaugggcaugaccuaccuggcccucauggccacguucaagaugcgcccgauguucgccgugggccugcuguuccggcgccucaccucccgggagguccugcugcucaccaucgggcugagccugguggcguccgucgagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgauggugcucagcaucgugucccuguucccccugugccucagcaccaccucccagaagaccacguggcugcccguccugcucggcagccuggggugcaagccgcugaccauguuccucaucgccgagaacaagaucuggggccgcaagagcuggccccugaacgaggggaucauggccgugggcaucguguccauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucacgauccugcugaaggccacccuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgagcgagggcgaggugggcgccaucgcgcuggacuucaagcccgggaccagcggcucccccaucgugaaccgcgaggggaagaucgucggccucuacggcaacgggguggugaccaccagcggcacguacgucuccgccaucgcccaggccaaggcgagccaggaggggccccugccggagaucgaggacgagguguuccggaagcgcaaccugaccaucauggaccuccaccccggcuccgggaagacccggcgcuaccugcccgccaucgugcgggaggccaucaagcgcaagcugcggacccucauccuggccccgacgcgcgucguggccagcgagauggcggaggcccugaagggcaugcccauccgcuaccagaccaccgccgugaaguccgagcacaccggcaaggagaucgucgaccucaugugccacgccacguucaccaugcggcugcugagccccgugcgcgugcccaacuacaacaugaucaucauggacgaggcccacuucaccgacccguccagcaucgcggcccggggguacaucuccacccgcgucggcaugggggaggccgccgccaucuucaugacggcgacgccgcccggcagcgccgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgcgaacugccuccggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccccgccggugccugaagccggugauccucaaggacgggcccgagcgcgucauccuggccggccccaugcccgugaccgucgccagcgcggcccagcggcgcgggcggaucggccgcaaccacaacaaggagggcgaccaguacaucuacauggggcagccgcugaacaacgacgaggaccacgcccacuggaccgaggccaagaugcuccuggacaacaucaacacccccgagggcaucauccccgcccuguucgagcccgagcgggagaaguccgcggccaucgacggggaguaccgccuccgcggcgaggcccggaagacguucguggagcugaugcgccgcggggaccugccgguguggcucuccuacaaggucgccagcgagggcuuccaguacuccgaccgccgguggugcuucgacggcgagcgcaacaaccaggugcuggaggagaacauggacguggagaucuggaccaaggagggggagcggaagaagcugcgcccccgguggcucgacgcccgcaccuacagcgacccccuggcgcugcgggaguucaaggaguucgccgccggccgccgguccgucagcggggaccucauccuggagaucggcaagcugccccagcaccucacccagcgcgcccagaacgcgcuggacaaccuggugaugcuccacaacuccgagcagggcgggcgggccuaccgccacgccauggaggagcugccggacacgaucgagacccugaugcuccuggcccugaucgccgugcucaccggcggggucacccuguucuuccugagcggccgggggcucggcaagacguccaucggccugcugugcgugauggcgagcuccgugcuccuguggauggccagcgucgagccccacuggaucgccgccuccaucauccuggaguucuuccucauggugcugcugauccccgagcccgaccgccagcggaccccgcaggacaaccagcucgccuacguggucaucgggcugcuguucaugauccucaccguggcggccaacgagaugggccugcuggagaccaccaagaaggaccucgggaucggccacguggccgucgagaaccaccaccacgccgccaugcuggacguggaccugcaccccgcgagcgccuggacgcucuacgccguggccaccaccaucaucacccccaugaugcgccacacgaucgagaacaccaccgccaacaucucccugaccgcgaucgccaaccaggccgccauccugauggggcucgacaagggcuggccgaucagcaagauggacaucggcgucccccugcuggcgcucgggugcuacucccaggugaacccccugacgcugaccgccgccgugcucaugcuggucgcccacuacgccaucaucggccccgggcugcaggcgaaggccacccgggaggcccagaagcgcaccgccgccggcaucaugaagaacccgacgguggacgggaucguggcgaucgaccucgaccccgucguguacgacgccaaguucgagaagcagcugggccagaucaugcugcucauccugugcaccagccagauccugcucaugcgcaccaccugggcccugugcgaguccaucacgcuggccaccggcccccucaccacccugugggaggggagccccggcaaguucuggaacacgaccaucgccgugagcauggcgaacaucuuccggggguccuaccuggccggcgccggccucgccuucagccugaugaagucccucgggggcgggcgccgggggaccggggcgcagggcgagacccucggcgagaaguggaagcgccagcugaaccagcugagcaaguccgaguucaacacguacaagcggagcgggaucauggaggucgaccgcuccgaggccaaggagggccucaagcgcggggagaccaccaagcacgccgugagccgcggcaccgccaagcugcggugguucguggagcgcaaccuggucaagccggaggggaaggugaucgaccucggcugcggccgcggcgggugguccuacuacugcgccgggcugaagaaggugacggaggucaagggguacaccaagggcggccccggccacgaggagcccauccccauggcgaccuacggguggaaccuggugaagcugcacagcggcaaggacguguucuucgucccgcccgagaagugcgacacccuccugugcgacaucggggaguccagccccaaccccacgaucgaggagggccgcacccugcgggugcucaagaugguggagccguggcugcgcgggaaccaguucugcaucaagauccugaaccccuacaugcccuccgucguggagacccucgagcagaugcagcggaagcacggcggcaugcuggugcgcaacccccugagccggaacuccacccacgagauguacugggucagcugcgggacgggcaacaucguguccgccgugaacaugaccagccgcaugcuccugaaccgguucaccauggcccaccgcaagccgaccuacgagcgcgacgucgaccugggggccggcacccggcacguggccguggagcccgaggucgcgaaccucgacaucaucggccagcgcaucgagaacaucaagcacgagcacaaguccacguggcacuacgacgaggacaaccccuacaagaccugggccuaccacgggagcuacgaggugaagcccagcggcuccgccagcuccauggucaacgggguggugaagcugcugaccaagccgugggacgucauccccauggugacccagaucgccaugacggacaccacccccuucggccagcagcggguguucaaggagaaggucgacacccgcacgcccaaggccaagcgggggaccgcgcagaucauggaggugaccgccaaguggcucuggggcuuccugagccgcaacaagaagccgcggaucugcacccgcgaggaguucacgcggaaggugcgcuccaacgccgccaucggcgcggucuucguggacgagaaccaguggaacagcgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggcgaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagaucagcgggggcaacauguacgccgacgacaccgccggcugggacacccggaucacggaggacgaccuccagaacgaggcgaagaucaccgacaucauggagcccgagcacgcccugcuggccaaguccaucuucaagcucaccuaccagaacaaggucgugcgcgugcagcggcccgccaagaacgggaccgucauggacgugaucagccgccgcgaccagcggggcuccggccaggugggcacguacggccugaacaccuucaccaacauggaggcccagcugauccgccagauggagagcgaggggaucuucuccccgagcgagcucgagacccccaaccuggcggagcgggcccuggacuggcucgagaagcacggcgucgagcgccugaagcggauggccaucagcggggacgacugcguggugaagcccaucgacgaccgcuucgccacggcccugaccgcgcucaacgacaugggcaagguccggaaggacaucccccagugggagccguccaagggguggaacgacuggcagcagguccccuucugcagccaccacuuccaccagcugaucaugaaggacggccgcgagaucgugguccccugccggaaccaggacgagcuggugggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgccguccccguggacugggugccgaccucccgcacgaccuggagcauccacgcgcaccaccaguggaugaccaccgaggacaugcuguccgucuggaaccggguguggaucgaggagaaccccuggauggaggacaagacgcacaucagcuccugggaggacgugcccuaccucggcaagcgcgaggaccaguggugcgggagccugaucggccugaccgcccgggccaccugggccaccaacauccaggucgccaucaaccaggugcgccgccucaucggcaacgagaacuaccuggacuacaugacguccaugaagcgguucaagaacgagagcgaccccgagggggcgcugugguga

SEQ ID NO: 8007 - RNA, 9879 nt, Artificial Sequence
  derived and/or modified CDS sequence (opt1) from DENV-1__FJ639669__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccucaaggacgggcccgagcgggucauccuggccggccccaugccggugacggucgccuccgccgcgcagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccguguggcucuccuacaaggucgccagcgagggcuuccaguacagcgaccggcgcuggugcuucgacggcgagcggaacaaccaggugcuggaggagaacauggacguggagaucuggacgaaggagggggagcgcaagaagcugcggccccgcuggcucgacgcccggaccuacuccgacccccuggcccugcgcgaguucaaggaguucgcggccggccggcgcagcgucuccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccggcggggucacccuguucuuccuguccggccgcgggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucacgguggccgcgaacgagaugggccugcuggagaccaccaagaaggaccucgggaucggccacguggccgucgagaaccaccaccacgccgccaugcuggacguggaccugcaccccgccuccgcguggacccucuacgccguggccacgaccaucaucaccccgaugaugcggcacaccaucgagaacacgaccgccaacaucagccugaccgccaucgcgaaccaggccgccauccugauggggcucgacaagggcuggcccaucuccaagauggacaucggcgucccccugcuggcccucgggugcuacagccaggugaacccccugacccugacggcggccgugcucaugcuggucgcccacuacgccaucaucggcccggggcugcaggccaaggcgacccgcgaggcccagaagcgcaccgccgccggcaucaugaagaaccccaccguggacgggaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggccaacaucuuccgcggguccuaccuggcgggcgccggccucgccuucagccugaugaagucccucgggggcgggcggcgcgggaccggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagacgaccaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacacgaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgaccaucgaggagggccggacgcugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggaccggcaacaucgucagcgcggugaacaugaccucccggaugcuccugaaccgcuucacgauggcccaccgcaagcccaccuacgagcgggacguggaccuggggaccggcacccgccacgucgccguggagcccgagguggccaaccucgacaucaucggccagcggaucgagaacaucaagcacgagcacaagagcacguggcacuacgacgaggacaaccccuacaagaccugggccuaccacggguccuacgaggucaagccgagcggcuccgcgagcagcauggugaacggggucgugaagcugcugaccaagcccugggacgugauccccauggucacccagaucgccaugacggacaccacccccuucggccagcagcgcguguucaaggagaagguggacacccggacgccgaaggccaagcgcgggaccgcccagaucauggaggucaccgcccgguggcucuggggcuuccugucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcccgcuuccucgaguucgaggcgcugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcccugcuggcgaaggccaucuucaagcucaccuaccagaacaaggugguccgcgugcagcgccccgccaagaacgggaccgugauggacgucaucucccggcgcgaccagcggggcagcggccagguggggacguacggccugaacaccuucaccaacauggaggcccagcugauccgccagauggaguccgaggggaucuucagccccuccgagcucgagacccccaaccuggccgagcgggcgcuggacuggcucgagaaguacggcguggagcgccugaagcggauggccaucagcggggacgacugcgucgugaagccgaucgacgaccgcuucgccacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcgcgggugucccagggggccggcuggagccuccgcgagaccgccugccugggcaagagcuacgcccagauguggcagcugauguacuuccaccggcgcgaccuccggcuggcggccaacgccaucugcuccgccgugcccgucgacugggugcccaccagccgcacgaccugguccauccacgcccaccaccaguggaugaccaccgaggacaugcugagcguguggaaccgggucuggaucgaggagaaccccuggauggaggacaagacgcacaucuccagcugggaggacgugccguaccucggcaagcgcgaggaccaguggugcgggucccugaucggccugaccgcgcgcgccaccugggccaccaacauccagguggccaucaaccagguccggcgccucaucggcaacgagaacuaccuggacuacaugaccagcaugaagcgguucaagaacgaguccgaccccgagggggcccugugguga

SEQ ID NO: 8008 - RNA, 9882 nt, Artificial Sequence
  derived and/or modified CDS sequence (opt1) from DENV-1__FJ639670__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggcccaggggaagaagaugauccggccccagcccauggaguacaaguacagcuggaaguccuggggcaaggccaagaucaucggcgccgacgcgcagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggcgguguucuuccuccugaucauggggcagcugacguggaacgaccucauccgccugugcaucauggugggcgccaacgccagcgaccgcauggggaugggcaccaccuaccuggcccucauggccaccuucaagaugcggccgauguucgcggucggccugcuguuccgccggcucacgucccgcgaggugcugcugcucaccaucgggcugagccugguggccuccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgcguggaagaccauggccauggugcucagcaucgucucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggaccaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacccccagcccgcccgagguggagcgcgcggugcuggacgacggcaucuaccggaucaugcagcgcggccugcucgggcggucccaggucggcguggggguguuccaggagaacgucuuccacaccauguggcacgugacccgcggcgccgugcugauguaccaggggaagcggcuggagcccagcugggccuccgucaagaaggaccucaucagcuacggcggcggguggcgccugcagggcuccuggaacacgggggaggagguccaggugaucgccgucgagcccggcaagaaccccaagaacgugcagaccgcccccgggaccuucaagacccccgagggcgaggugggcgcgaucgcccuggacuucaagcccgggacgagcggcucccccaucgucaaccgggaggggaagaucgugggccucuacggcaacgggguggucaccaccagcggcaccuacgugagcgccaucgcccaggcgaaggccucccaggaggggccgcugcccgagaucgaggacgagguguuccgcaagcggaaccugacgaucauggaccuccaccccggcagcgggaagacccgccgguaccugccggccaucguccgcgaggccaucaagcggaagcugcgcacccucauccuggcccccacccgcgugguggcguccgagauggccgaggcccugaagggcaugcccauccgguaccagacgaccgccgucaagagcgagcacaccggcaaggagaucguggaccucaugugccacgccaccuucacgaugcgccugcugucccccgugcgggucccgaacuacaacaugaucaucauggacgaggcgcacuucaccgaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccuccgcaagaacgggaagcgggucauccagcugucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccucaaggacgggcccgagcgggugauccuggccggccccaugccggucacgguggccuccgcggcccagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgcggccaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggacgaaggagggggugucccgcaagaaccugcggccccgcuggcucgacgcccggaccuacagcgacccccuggcgcugcgcgaguucaaggaguucgccgccggccggcgcuccgucagcggggaccucauccuggagaucggcaagcugccgcagcaccucacccagcgggcccagaacgcgcuggacaaccuggugaugcuccacaacuccgagcagggcgggcgcgccuaccggcacgccauggaggagcugcccgacaccaucgagacgcugaugcuccuggcccugaucgccgugcucaccggcggggucacccuguucuuccugagcggccgcgggcucggcaagaccuccaucggccugcugugcgugauggcgagcuccgugcuccuguggaucgccagcgucgagccccacuggaucgccgccuccaucauccuggaguucuuccucauggugcugcugauccccgagccggaccggcagcgcacgccccaggacaaccagcucgccuacguggucaucgggcugcuguucaugauccucacgguggcggccaacgagaugggccugcuggagaccaccaagaaggaccucgggaucggccacguggccgucgagaaccaccaccacgccgccaugcuggacguggaccugcaccccgcgagcgccuggacccucuacgccguggccacgaccaucaucaccccgaugaugcggcacaccaucgagaacacgaccgccaacaucucccugaccgcgaucgccaaccaggccgccauccugauggggcucgacaagggcuggcccaucagcaagauggacaucggcgucccccugcuggcgcucgggugcuacucccaggugaacccccugacccugacggccgccgugcucaugcuggucgcccacuacgccaucaucggcccggggcugcaggcgaaggccacccgcgaggcccagaagcgcaccgccgccggcaucaugaagaaccccaccguggacgggaucguggcgaucgaccucgaccccgucguguacgacgccaaguucgagaagcagcugggccagaucaugcugcucauccugugcacgagccagauccugcucaugcggaccaccugggcccugugcgaguccaucacccuggccacgggcccccucaccacccugugggaggggagcccgggcaaguucuggaacaccacgaucgccguguccauggcgaacaucuuccgcgggagcuaccuggccggcgccggccucgccuucagccugaugaagucccucgggggcgggcggcgcgggaccggggcgcagggcgagacccucggcgagaaguggaagcggcagcugaaccagcugagcaaguccgaguucaacaccuacaagcgcagcgggaucauggaggucgaccgguccgaggccaaggagggccucaagcgcggggagacgaccaagcacgccgugagccggggcaccgccaagcugcgcugguucguggagcggaaccuggucaagcccgaggggaaggugaucgaccugggcugcggccgcgggggcugguccuacuacugcgccgggcucaagaaggugaccgaggucaagggcuacacgaagggcgggcccggccacgaggagcccaucccgauggcgaccuacggguggaaccuggugaagcugcacagcggcaaggacguguucuucaucccgcccgagaagugcgacacccuccugugcgacaucggggaguccagcuccaaccccaccaucgaggagggccggacgcugcgcguccucaagaugguggagccguggcugcgggggaaccaguucugcaucaagauccugaaccccuacaugcccagcguggucgagacccucgagcagaugcagcgcaagcacggcggcaugcuggugcggaacccccugucccgcaacagcacccacgagauguacuggguguccugcgggaccggcaacaucgucagcgccgugaacaugaccucccggaugcuccugaaccgcuucacgauggcccaccgcaagccgaccuacgagcgggacguggaccuggggaccggcacccgccacgucgccguggagcccgagguggccaaccucgacaucaucggccagcggaucgagaacaucaagcacgagcacaagagcacguggcacuacgacgaggacaaccccuacaagaccugggcguaccacggguccuacgaggucaagcccagcggcagcgccuccagcauggugaacggggucgugaagcugcugaccaagccgugggacgugauccccauggucacccagaucgccaugacggacaccacccccuucggccagcagcgcguguucaaggagaagguggacacccggacgcccaaggccaagcgcgggaccgcccagaucauggaggucaccgcgcgguggcucuggggcuuccugucccgcaacaagaagccgcggaucugcacccgcgaggaguucacgcggaaggugcgcagcaacgccgccaucggcgccguguucgucgacgagaaccaguggaacuccgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagcccgagcacgcgcugcuggccaaggccaucuucaagcucaccuaccagaacaaggugguccgcgugcagcgcccggccaagaacgggaccgugauggacgucaucucccggcgcgaccagcggggcagcggccagguggggacguacggccugaacaccuucaccaacauggaggcccagcugauccgccagauggaguccgaggggaucuucagccccuccgagcucgagacccccaaccuggcggagcgggcccuggacuggcucgagaaguacggcguggagcgccugaagcggauggccaucagcggggacgacugcgucgugaagcccaucgacgaccgcuucgccacggcccugaccgcgcucaacgacaugggcaaggugcggaaggacaucccgcagugggagcccuccaagggguggaacgacuggcagcagguccccuucugcagccaccacuuccaccagcugaucaugaaggacggccgcgagaucguggugcccugccggaaccaggacgagcuggucggccgcgcccgggugagccagggggccggcuggucccuccgcgagaccgccugccugggcaagagcuacgcgcagauguggcagcugauguacuuccaccggcgcgaccuccggcuggccgccaacgccaucugcuccgccgugccggucgacugggugcccaccagccgcacgaccugguccauccacgcgcaccaccaguggaugaccaccgaggacaugcugagcguguggaaccgggucuggaucgaggagaaccccuggauggaggacaagacgcacaucuccagcugggaggacgugcccuaccucggcaagcgcgaggaccaguggugcgggucccugaucggccugaccgcccgcgccaccugggccaccaacauccagguggccaucaaccagguccggcgccucaucggcaacgagaacuaccuggacuacaugaccagcaugaagcgguucaagaacgaguccgacccggagggggcgcugugguga

SEQ ID NO: 8009 - RNA, 9879 nt, Artificial Sequence
  derived and/or modified CDS sequence (opt1) from DENV-1__FJ639671__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccgcaucaccgagguggagcccgacgacguggacugcuggugcaacaccacggacaccugggugaccuacgggaccugcagccagacgggcgagcaccggcgcgacaagcggagcguggcccuggcgccccacgugggccuggggcucgagacccgcgccgagaccuggaugagcagcgagggcgcguggaagcagauccagcggguggagaccugggcccugcgccaccccggguucacggugaucgcccuguuccucgcccacgcgaucggcaccagcaucacccagaaggggaucaucuucauccugcugaugcucgucacccccuccauggccaugcggugcgugggcaucggcagccgcgacuucguggaggggcuguccggcgccacgugggucgacguggugcuggagcacgggagcugcgucaccaccauggccaaggacaagcccacccucgacaucgagcugcugaagacggaggugaccaaccccgccgugcuccggaagcugugcaucgaggcgaagaucuccaacaccaccacggacagccgcugccccacccagggcgaggccacccuggucgaggagcaggacgccaacuucgugugccggcgcaccuucguggaccggggcugggggaacggcugcggccuguucggcaaggggucccugaucacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccagcggggccuccaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccuggugcagaucaaguacgagggcaccgacgcgcccugcaagauccccuucuccacccaggacgggaagggcgugacccagaacgggcggcugaucacggccaacccgaucgucaccgacaaggagaagcccgugaacaucgaggccgagccgcccuucggcgagagcuacaucgugaucggcgccggggagaaggcgcucaagcuguccugguucaagaagggcagcuccaucgggaagauguucgaggccaccgcccgcggcgcccggcgcauggccauccugggggacaccgcgugggacuucggcagcgucggcgggguguucacguccgugggcaagcucguccaccagaucuucgggaccgccuacggcgugcuguucagcgggguguccuggaccaugaagaucggcaucggcguccugcucaccuggcuggggcugaacagccgcuccacgagccucuccaugaccugcaucgccgugggccuggugacccuguaccucggggucauggugcaggccgacagcggcugcgugaucaacuggaaggggcgggagcugaagugcggcagcggcaucuucgucaccaacgaggugcacacguggaccgagcaguacaaguuccaggccgacuccccgaagcgccugagcgcggccaucgggaaggccugggaggagggcgugugcgggauccgguccgccacccgccucgagaacgucauguggcggcagaucagcaacgagcugaaccacauccugcucgagaacgacaugaaguucaccgugguggucggcgacgugguggggauccuggcccagggcaagaagaugauccgcccccagcccauggagcacaaguacuccuggaaguccuggggcaaggcgaagaucaucggggccgacguccagaacaccacguucaucaucgacggccccaacaccuccgagugcccggacgaccagcgggccuggaacaucugggagguggaggacuacggguucggcaucuucaccaccaacaucuggcugaagcuccgcgacagcuacacccaggugugcgaccaccggcugauguccgccgcgaucaaggacagccgcgccguccacgccgacaugggcuacuggaucgaguccgagaagaacgagaccuggaagcuggcccgggccagcuucaucgaggugaagaccugcaucuggcccaagucccacacccucuggagcaacggggugcuggaguccgagaugaucauccccaagaucuacggcgggcccaucagccagcacaacuaccgcccgggcuacuucacgcagaccgcggggcccuggcaccugggcaagcucgagcuggacuucgaccugugcgagggcaccaccgucgugguggacgagcacugcgggaaccggggccccucccuccgcacgaccaccgucaccgggaagaucauccacgaguggugcugccggagcugcacgcugccgccccugcgcuucaagggcgaggacgggugcugguacggcauggagauccggcccgugaaggagaaggaggagaaccucgucaagagcauggucuccgccggcagcggggagguggacuccuucagccugggccugcucugcaucuccaucaugaucgaggaggugaugcgcagccgguggucccgcaagaugcugaugaccgggacccuggccgucuucuuccuccugaucaugggccagcugaccuggaacgaccucauccgccugugcaucauggugggggccaacgccagcgaccggaugggcaugggcacgacguaccuggcgcucauggccaccuucaagaugcgccccauguucgccgucgggcugcuguuccggcgccucaccucccgggaggugcugcugcucacgaucgggcugagccugguggccuccgucgagcucccgaacagccuggaggagcugggggacggccucgccaugggcaucaugauccugaagcugcucaccgacuuccaguccuaccagcugugggcgacccugcucagccugaccuucaucaagacgaccuucucccugcacuacgccuggaagaccauggccauggugcucagcaucgugucccugcugccccucugccugagcaccacgucccagaagaccaccuggcugcccguccuccuggggagccugggcugcaagccccucaccauguuccugaucgccgagaacaagaucugggggcgcaagagcuggccgcugaacgagggcaucauggcgguggggaucguguccauccuccugagcucccugcucaagaacgacgucccccuggccggcccccugaucgccggcgggaugcucaucgccugcuacgugaucagcggcuccagcgccgaccugucccuggagaaggcggccgaggugagcugggaggaggaggccgagcacuccggggccagccacaacauccucgucgaggugcaggacgacggcacgaugaagaucaaggacgaggagcgggacgacacccugaccauccugcucaaggccacccugcuggcgguguccggggucuacccccucagcaucccggccacccuguucgugugguacuucuggcagaagaagaagcagcgcuccggcgugcugugggacacgcccuccccgcccgaggucgagcgggccgugcuggacgacggcaucuaccgcaucaugcagcgggggcuccugggccgcucccaggugggggucggcguguuccaggagaacguguuccacaccauguggcacgucacccgcggggccgugcugauguaccagggcaagcgccucgagccgagcugggccuccgugaagaaggaccugaucagcuacggcgggggcuggcggcugcagggguccuggaacaccggcgaggagguccaggugaucgcgguggagcccgggaagaaccccaagaacguccagacggcccccggcaccuucaagaccccggagggcgaggugggggccaucgcccucgacuucaagcccggcaccagcgggagccccaucgugaaccgcgagggcaagaucgucggccuguacgggaacggcguggugacgaccuccgggaccuacgucagcgccaucgcgcaggccaaggccucccaggagggcccccugccggagaucgaggacgagguguuccggaagcgcaaccucaccaucauggaccugcaccccgggagcggcaagacgcggcgcuaccugcccgccaucgugcgggaggcgaucaagcgcaagcuccgcacccugauccuggccccgacccgggucguggccuccgagauggccgaggcccucaagggcaugcccauccgcuaccagaccacggcggucaagagcgagcacaccgggcgggagaucgucgaccugaugugccacgccaccuucaccaugcgccugcucucccccgugcgggugcccaacuacaacaugaucaucauggacgaggcccacuucacggacccgagcuccaucgccgcccgcggcuacaucagcacccgggucgggaugggcgaggcggccgccaucuucaugaccgccacgccgcccggguccguggaggccuucccccagagcaacgcggugauccaggacgaggagcgcgacaucccggagcgguccuggaacagcggcuacgaguggaucacggacuuccccggcaagaccgucugguucgugcccuccaucaagagcgggaacgacaucgccaacugccugcgcaagaacggcaagcgggugauccagcugucccgcaagaccuucgacaccgaguaccagaagacgaagaacaacgacugggacuacgucgugaccaccgacaucagcgagaugggggccaacuuccgggccgaccgcgucaucgacccccggcgcugccucaagccggugauccugaaggacggccccgagcgggugauccuggcggggcccaugcccgucaccguggccuccgccgcccagcgccggggccgcaucggccgcaaccacaacaaggagggggaccaguacaucuacaugggccagccgcucaacaacgacgaggaccacgcccacuggacggaggcgaagaugcugcuggacaacaucaacacccccgaggggaucauccccgcccucuucgagcccgagcgggagaaguccgccgccaucgacggcgaguaccgccugcgcggggaggcccgcaagaccuucguggagcugaugcggcgcggcgaccucccggucuggcugagcuacaagguggcguccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggacguacuccgacccccuggcccuccgcgaguucaaggaguucgccgccgggcggcgcagcguguccggcgaccugauccuggagaucggcaagcucccccagcaccugacccagcgggcgcagaacgcccuggacaaccucgugaugcugcacaacagcgagcagggcgggcgcgccuaccggcacgccauggaggagcugccggagaccaucgagacccucaugcugcuggcgcucaucgccguccugaccggcggggugacccuguucuuccucuccgggcgcgggcugggcaagaccagcaucgggcugcucugcgugauggccuccagcgcccugcuguggauggccuccgucgagccccacuggaucgcggccagcaucauccucgaguucuuccugauggugcugcucauccccgagcccgaccggcagcgcaccccgcaggacaaccagcuggccuacguggucaucggccuccucuucaugauccugaccguggccgccaacgagauggggcugcucgagacgaccaagaaggaccugggcaucgggcacguggcggucgagaaccaccaccacgccaccaugcuggacguggaccuccaccccgccuccgccuggacccuguacgccguggcgacgaccaucaucacccccaugaugcgccacaccaucgagaacacgaccgccaacaucagccugaccgccaucgccaaccaggccgcgauccucaugggccuggacaagggcuggccgaucuccaagauggacaucggggucccccugcucgcccugggcugcuacagccaggugaacccccugacccucacggccgccgugcugaugcuggucgcgcacuacgccaucaucgggcccggccuccaggccaaggccacccgggaggcccagaagcgcaccgcggccgggaucaugaagaacccgaccguggacggcaucguggccaucgaccuggaccccgucguguacgacgccaaguucgagaagcagcugggccagaucaugcuccugauccugugcacgucccagauccuccugaugcggaccaccugggcccugugcgagagcaucacccucgcgacggggccccugaccacccugugggagggcucccccgggaaguucuggaacaccacgaucgccgugagcauggccaacaucuuccgcggcagcuaccucgccggcgccgggcuggcguucucccugaugaagucccucggcgggggccggcgcgggaccggcgcccagggcgagacccugggggagaaguggaagcggcagcugaaccagcucuccaagagcgaguucaacaccuacaagcgcuccggcaucauggaggucgaccggagcgaggccaaggaggggcugcgccggggcgagacgaccaagcacgccgugucccgcgggaccgcgaagcugcggugguucguggagcgcaaccuggucaagccggagggcaaggugaucgaccucggcugcgggcggggcggguggagcuacuacugcgccggccugaagaaggugaccgaggucaagggguacacgaagggcggccccgggcacgaggagcccauccccauggccaccuacggcuggaaccuggugaagcuccacuccgggaaggacguguucuucaucccgcccgagaagugcgacacccugcugugcgacaucggcgagagcucccccaaccccaccaucgaggaggggcgcacgcuccggguccugaagaugguggagccguggcugcgcggcaaccaguucugcaucaagauccucaaccccuacaugcccagcguggucgagacccuggagcagaugcagcggaagcacggcgggaugcuggugcgcaacccccucucccgcaacagcacccacgagauguacuggguguccugcggcaccgggaacaucgucagcgccgugaacaugaccucccggaugcugcugaaccgcuucacgauggcccaccggaagccgaccuacgagcgcgacguggaccucggcgcgggcacccggcacgucgccguggagcccgaggucgccaaccuggacaucaucgggcagcgcaucgagaacaucaagcacgagcacaagagcaccuggcacuacgacgaggacaaccccuacaagacgugggccuaccacggcuccuacgaggugaagcccagcgggagcgccuccagcauggugaacggcgucgugaagcugcucaccaagccgugggacgugauccccauggucacccagaucgcgaugaccgacacgacccccuucgggcagcagcggguguucaaggagaagguggacacccgcacccccaaggccaagcggggcacggcccagaucauggaggucaccgcccgcuggcuguggggcuuccugucccggaacaagaagccgcgcaucugcacccgggaggaguucacccgcaaggugcggagcaacgccgcgaucggggccguguucgucgacgagaaccaguggaacuccgccaaggaggccguggaggacgagcgcuucugggaccucgugcaccgggagcgcgagcugcacaagcagggcaagugcgcgacgugcgucuacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgcgacaucagcaagauccccggcggcaacauguacgcggacgacaccgccgggugggacacccggaucaccgaggacgaccugcagaacgaggccaagaucacggacaucauggagcccgagcacgcccugcucgccaccuccaucuucaagcugaccuaccagaacaaggugguccgcgugcagcggccggcgaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagacccccaaccuggccgagcgcgugcucgacuggcuggagaaguacggggucgagcggcugaagcgcauggccaucuccggcgacgacugcguggugaagcccaucgacgaccgguucgccacggcgcucaccgcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgccggguggagccugcgggagaccgccugccugggcaaguccuacgcgcagauguggcagcucauguacuuccaccgccgggaccugcgccuggccgccaacgccaucugcagcgcggucccgguggacugggugcccaccucccgcacgaccuggagcauccacgcccaccaccaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggccaccugggccaccaacauccaggucgcgaucaaccaggugcgccggcugaucggcaacgagaacuaccuggacuacaugaccuccaugaagcgcuucaagaacgagagcgacccggagggggcccucugguga

SEQ ID NO: 8010 - RNA, 9879 nt, Artificial Sequence
  derived and/or modified CDS sequence (opt1) from DENV-1__JN819423__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgagcugugcgaggacacccucaccuacaagugcccccgcaucaccgagguggagcccgacgacguggacugcuggugcaacaccacggacaccugggugaccuacgggaccugcagccagacgggcgagcaccggcgcgacaagcggagcguggcccuggcgccccacgugggccuggggcucgagacccgcgccgagaccuggaugagcagcgagggcgcguggaagcagauccagcggguggagaccugggcccugcgccaccccggguucacggugaucgcccuguuccucgcccacgcgaucggcaccagcaucacccagaaggggaucaucuucauccugcugaugcucgucacccccuccauggccaugcggugcgugggcaucggcagccgcgacuucguggaggggcuguccggcgccacgugggucgacguggugcuggagcacgggagcugcgucaccaccauggccaaggacaagcccacccucgacaucgagcugcugaagacggaggugaccaaccccgccgugcuccggaagcugugcaucgaggcgaagaucuccaacaccaccacggacagccgcugccccacccagggcgaggccacccuggucgaggagcaggacgccaacuucgugugccggcgcaccuucguggaccggggcugggggaacggcugcggccuguucggcaaggggucccugaucacgugcgccaaguucaagugcgucaccaagcuggagggcaagaucgugcaguacgagaaccucaaguacagcgugaucgucaccgugcacaccggcgaccagcaccaggucgggaacgaguccacggagcacggcaccaccgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccagcggggccuccaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccuggugcagaucaaguacgagggcaccgacgcgcccugcaagauccccuucuccacccaggacgggaagggcgugacccagaacgggcggcugaucacggccaacccgaucgucaccgacaaggagaagcccgugaacaucgaggccgagccgcccuucggcgagagcuacaucgugaucggcgccggggagaaggcgcucaagcuguccugguucaagaagggcagcuccaucgggaagauguucgaggccaccgcccgcggcgcccggcgcauggccauccugggggacaccgcgugggacuucggcagcgucggcgggguguucacguccgugggcaagcucguccaccagaucuucgggaccgccuacggcgugcuguucagcgggguguccuggaccaugaagaucggcaucggcguccugcucaccuggcuggggcugaacagccgcuccacgagccucuccaugaccugcaucgccgugggccuggugacccuguaccucggggucauggugcaggccgacagcggcugcgugaucaacuggaaggggcgggagcugaagugcggcagcggcaucuucgucaccaacgaggugcacacguggaccgagcaguacaaguuccaggccgacuccccgaagcgccugagcgcggccaucgggaaggccugggaggagggcgugugcgggauccgguccgccacccgccucgagaacgucauguggcggcagaucagcaacgagcugaaccacauccugcucgagaacgacaugaaguucaccgugguggucggcgacgugguggggauccuggcccagggcaagaagaugauccgcccccagcccauggagcacaaguacuccuggaaguccuggggcaaggcgaagaucaucggggccgacguccagaacaccacguucaucaucgacggccccaacaccuccgagugcccggacgaccagcgggccuggaacaucugggagguggaggacuacggguucggcaucuucaccaccaacaucuggcugaagcuccgcgacagcuacacccaggugugcgaccaccggcugauguccgccgcgaucaaggacagccgcgccguccacgccgacaugggcuacuggaucgaguccgagaagaacgagaccuggaagcuggcccgggccagcuucaucgaggugaagaccugcaucuggcccaagucccacacccucuggagcaacggggugcuggaguccgagaugaucauccccaagaucuacggcgggcccaucagccagcacaacuaccgcccgggcuacuucacgcagaccgcggggcccuggcaccugggcaagcucgagcuggacuucgaccugugcgagggcaccaccgucgugguggacgagcacugcgggaaccggggccccucccuccgcacgaccaccgucaccgggaagaucauccacgaguggugcugccggagcugcacgcugccgccccugcgcuucaagggcgaggacgggugcugguacggcauggagauccggcccgugaaggagaaggaggagaaccucgucaagagcauggucuccgccggcagcggggagguggacuccuucagccugggccugcucugcaucuccaucaugaucgaggaggugaugcgcagccgguggucccgcaagaugcugaugaccgggacccuggccgucuucuuccuccugaucaugggccagcugaccuggaacgaccucauccgccugugcaucauggugggggccaacgccagcgaccggaugggcaugggcacgacguaccuggcgcucauggccaccuucaagaugcgccccauguucgccgucgggcugcuguuccggcgccucaccucccgggaggugcugcugcucacgaucgggcugagccugguggccuccgucgagcucccgaacagccuggaggagcugggggacggccucgccaugggcaucaugauccugaagcugcucaccgacuuccaguccuaccagcugugggcgacccugcucagccugaccuucaucaagacgaccuucucccugcacuacgccuggaagaccauggccauggugcucagcaucgugucccugcugccccucugccugagcaccacgucccagaagaccaccuggcugcccguccuccuggggagccugggcugcaagccccucaccauguuccugaucgccgagaacaagaucugggggcgcaagagcuggccgcugaacgagggcaucauggcgguggggaucguguccauccuccugagcucccugcucaagaacgacgucccccuggccggcccccugaucgccggcgggaugcucaucgccugcuacgugaucagcggcuccagcgccgaccugucccuggagaaggcggccgaggugagcugggaggaggaggccgagcacuccggggccagccacaacauccucgucgaggugcaggacgacggcacgaugaagaucaaggacgaggagcgggacgacacccugaccauccugcucaaggccacccugcuggcgguguccggggucuacccccucagcaucccggccacccuguucgugugguacuucuggcagaagaagaagcagcgcuccggcgugcugugggacacgcccuccccgcccgaggucgagcgggccgugcuggacgacggcaucuaccgcaucaugcagcgggggcuccugggccgcucccaggugggggucggcguguuccaggagaacguguuccacaccauguggcacgucacccgcggggccgugcugauguaccagggcaagcgccucgagccgagcugggccuccgugaagaaggaccugaucagcuacggcgggggcuggcggcugcagggguccuggaacaccggcgaggagguccaggugaucgcgguggagcccgggaagaaccccaagaacguccagacggcccccggcaccuucaagaccccggagggcgaggugggggccaucgcccucgacuucaagcccggcaccagcgggagccccaucgugaaccgcgagggcaagaucgucggccuguacgggaacggcguggugacgaccuccgggaccuacgucagcgccaucgcgcaggccaaggccucccaggagggcccccugccggagaucgaggacgagguguuccggaagcgcaaccucaccaucauggaccugcaccccgggagcggcaagacgcggcgcuaccugcccgccaucgugcgggaggcgaucaagcgcaagcuccgcacccugauccuggccccgacccgggucguggccuccgagauggccgaggcccucaagggcaugcccauccgcuaccagaccacggcggucaagagcgagcacaccgggcgggagaucgucgaccugaugugccacgccaccuucaccaugcgccugcucucccccgugcgggugcccaacuacaacaugaucaucauggacgaggcccacuucacggacccgagcuccaucgccgcccgcggcuacaucagcacccgggucgggaugggcgaggcggccgccaucuucaugaccgccacgccgcccggguccguggaggccuucccccagagcaacgcggugauccaggacgaggagcgcgacaucccggagcgguccuggaacagcggcuacgaguggaucacggacuuccccggcaagaccgucugguucgugcccuccaucaagagcgggaacgacaucgccaacugccugcgcaagaacggcaagcgggugauccagcugucccgcaagaccuucgacaccgaguaccagaagacgaagaacaacgacugggacuacgucgugaccaccgacaucagcgagaugggggccaacuuccgggccgaccgcgucaucgacccccggcgcugccucaagccggugauccugaaggacggccccgagcgggugauccuggcggggcccaugcccgucaccguggccuccgccgcccagcgccggggccgcaucggccgcaaccacaacaaggagggggaccaguacaucuacaugggccagccgcucaacaacgacgaggaccacgcccacuggacggaggcgaagaugcugcuggacaacaucaacacccccgaggggaucauccccgcccucuucgagcccgagcgggagaaguccgccgccaucgacggcgaguaccgccugcgcggggaggcccgcaagaccuucguggagcugaugcggcgcggcgaccucccggucuggcugagcuacaagguggcguccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggacguacuccgacccccuggcccuccgcgaguucaaggaguucgccgccgggcggcgcagcguguccggcgaccugauccuggagaucggcaagcucccccagcaccugacccagcgggcgcagaacgcccuggacaaccucgugaugcugcacaacagcgagcagggcgggcgcgccuaccggcacgccauggaggagcugccggagaccaucgagacccucaugcugcuggcgcucaucgccguccugaccggcggggugacccuguucuuccucuccgggcgcgggcugggcaagaccagcaucgggcugcucugcgugauggccuccagcgcccugcuguggauggccuccgucgagccccacuggaucgcggccagcaucauccucgaguucuuccugauggugcugcucauccccgagcccgaccggcagcgcaccccgcaggacaaccagcuggccuacguggucaucggccuccucuucaugauccugaccguggccgccaacgagauggggcugcucgagacgaccaagaaggaccugggcaucgggcacguggcggucgagaaccaccaccacgccaccaugcuggacguggaccuccaccccgccuccgccuggacccuguacgccguggcgacgaccaucaucacccccaugaugcgccacaccaucgagaacacgaccgccaacaucagccugaccgccaucgccaaccaggccgcgauccucaugggccuggacaagggcuggccgaucuccaagauggacaucggggucccccugcucgcccugggcugcuacagccaggugaacccccugacccucacggccgccgugcugaugcuggucgcgcacuacgccaucaucgggcccggccuccaggccaaggccacccgggaggcccagaagcgcaccgcggccgggaucaugaagaacccgaccguggacggcaucguggccaucgaccuggaccccgucguguacgacgccaaguucgagaagcagcugggccagaucaugcuccugauccugugcacgucccagauccuccugaugcggaccaccugggcccugugcgagagcaucacccucgcgacggggccccugaccacccugugggagggcucccccgggaaguucuggaacaccacgaucgccgugagcauggccaacaucuuccgcggcagcuaccucgccggcgccgggcuggcguucucccugaugaagucccucggcgggggccggcgcgggaccggcgcccagggcgagacccugggggagaaguggaagcggcagcugaaccagcucuccaagagcgaguucaacaccuacaagcgcuccggcaucauggaggucgaccggagcgaggccaaggaggggcugcgccggggcgagacgaccaagcacgccgugucccgcgggaccgcgaagcugcggugguucguggagcgcaaccuggucaagccggagggcaaggugaucgaccucggcugcgggcggggcggguggagcuacuacugcgccggccugaagaaggugaccgaggucaagggguacacgaagggcggccccgggcacgaggagcccauccccauggccaccuacggcuggaaccuggugaagcuccacuccgggaaggacguguucuucaucccgcccgagaagugcgacacccugcugugcgacaucggcgagagcucccccaaccccaccaucgaggaggggcgcacgcuccggguccugaagaugguggagccguggcugcgcggcaaccaguucugcaucaagauccucaaccccuacaugcccagcguggucgagacccuggagcagaugcagcggaagcacggcgggaugcuggugcgcaacccccucucccgcaacagcacccacgagauguacuggguguccugcggcaccgggaacaucgucagcgccgugaacaugaccucccggaugcugcugaaccgcuucacgauggcccaccggaagccgaccuacgagcgcgacguggaccucggcgcgggcacccggcacgucgccguggagcccgaggucgccaaccuggacaucaucgggcagcgcaucgagaacaucaagcacgagcacaagagcaccuggcacuacgacgaggacaaccccuacaagacgugggccuaccacggcuccuacgaggugaagcccagcgggagcgccuccagcauggugaacggcgucgugaagcugcucaccaagccgugggacgugauccccauggucacccagaucgcgaugaccgacacgacccccuucgggcagcagcggguguucaaggagaagguggacacccgcacccccaaggccaagcggggcacggcccagaucauggaggucaccgcccgcuggcuguggggcuuccugucccggaacaagaagccgcgcaucugcacccgggaggaguucacccgcaaggugcggagcaacgccgcgaucggggccguguucgucgacgagaaccaguggaacuccgccaaggaggccguggaggacgagcgcuucugggaccucgugcaccgggagcgcgagcugcacaagcagggcaagugcgcgacgugcgucuacaacaugauggggaagcgggagaagaagcugggcgaguucgggaaggccaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgcgacaucagcaagauccccggcggcaacauguacgcggacgacaccgccgggugggacacccggaucaccgaggacgaccugcagaacgaggccaagaucacggacaucauggagcccgagcacgcccugcucgccaccuccaucuucaagcugaccuaccagaacaaggugguccgcgugcagcggccggcgaagaacggcaccgugauggacgucaucagccgccgggaccagcgcggguccggccaggugggcacguacgggcugaacaccuucaccaacauggaggcccagcucauccggcagauggagagcgagggcaucuucucccccagcgagcuggagacccccaaccuggccgagcgcgugcucgacuggcuggagaaguacggggucgagcggcugaagcgcauggccaucuccggcgacgacugcguggugaagcccaucgacgaccgguucgccacggcgcucaccgcccugaacgacauggggaagguccgcaaggacaucccgcagugggagcccagcaagggcuggaacgacuggcagcagguccccuucugcagccaccacuuccaccagcugaucaugaaggacggccgggagaucgugguccccugccgcaaccaggacgagcucguggggcgggcccgcgugucccagggcgccggguggagccugcgggagaccgccugccugggcaaguccuacgcgcagauguggcagcucauguacuuccaccgccgggaccugcgccuggccgccaacgccaucugcagcgcggucccgguggacugggugcccaccucccgcacgaccuggagcauccacgcccaccagcaguggaugaccaccgaggacaugcucuccgucuggaaccggguguggaucgaggagaaccccuggauggaggacaagacgcacaucagcuccuggggcgacgugcccuaccugggcaagcgcgaggaccaguggugcggcagccugaucgggcucaccgcccgggccaccugggccaccaacauccaggucgcgaucaaccaggugcgccggcugaucggcaacgagaacuaccuggacuacaugaccuccaugaagcgcuucaagaacgagagcgacccggagggggcccucugguga

SEQ ID NO: 8011 - RNA, 9879 nt, Artificial Sequence
  derived and/or modified CDS sequence (opt1) from DENV-1__FJ639672__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucagcucccgcgacuucguggagggccucagcggggccacguggguggacgucgugcuggagcacggcuccugcgugaccaccauggccaaggacaagcccacccuggacaucgagcuccugaagacggaggucaccaaccccgcggugcugcggaagcucugcaucgaggccaagaucagcaacaccaccacggacucccgcugcccgacccagggggaggccacccugguggaggagcaggacgccaacuucgucugccggcgcaccuucguggaccggggcuggggcaacgggugcggccuguucgggaagggcagccucaucacgugcgccaaguucaagugcgugaccaagcuggaggggaagaucguccaguacgagaaccugaaguacuccgugaucgugaccguccacaccggcgaccagcaccaggugggcaacgagagcacggagcacgggaccaccgcgaccaucacgccccaggcccccacgaccgagauccagcucaccgacuacggcgcccugacccuggacugcagcccccggacggggcucgacuucaacgagaugguccugcugaccaugaaggagaaguccuggcucgugcacaagcagugguuccuggaccugccccuccccuggaccagcggcgccuccaccagccaggagacguggaaccggcaggaccugcuggugaccuucaagaccgcccacgcgaagaagcaggaggucguggugcucgggucccaggagggcgccaugcacaccgcccugacgggcgccaccgagauccagaccagcgggaccacgaccaucuucgccggccaccugaagugccgccucaagauggacaagcugacccugaaggggauguccuacgucaugugcaccggcagcuucaagcucgagaaggagguggcggagacgcagcacgggaccgugcugguccagaucaaguacgagggcaccgacgcccccugcaagauccccuucuccacccaggacgagaagggcgugacgcagaacgggcggcugaucaccgccaacccgaucgugaccgacaaggagaagcccgucaacaucgaggccgagccgcccuucggcgagagcuacaucgugaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgucggcaagcuggugcaccagaucuucgggaccgccuacggcguccucuucagcggggucuccuggaccaugaagaucggcaucggggugcugcugacguggcucggccugaacagccgcuccaccagccuguccaugaccugcaucgccgugggccucgucacccuguaccugggggugauggugcaggccgacagcggcugcgucaucaacuggaaggggcgggagcucaagugcggcagcgggaucuucgugacgaacgaggugcacaccuggaccgagcaguacaaguuccaggcggacuccccgaagcgccugagcgccgccaucggcaaggccugggaggagggcgucugcgggauccgguccgccacccgccuggagaacaucauguggaagcagaucagcaacgagcucaaccacauccugcuggagaacgacaugaagcucaccgugguggucggcgacguggcggggauccuggcccagggcaagaagaugauccggccccagcccauggaguacaaguacuccuggaaguccugggggaaggccaagaucaucggcgccgacgugcagaacacgaccuucaucaucgacggccccaacaccccggagugccccgacgaccagcgcgcguggaacaucugggaggucgaggacuacggguucggcaucuucaccacgaacaucuggcugaagcuccgggacuccuacacccaggugugcgaccaccgccugaugagcgccgccaucaaggacuccaaggccgugcacgccgacaugggguacuggaucgagagcgagaagaacgagaccuggaagcuggcgcgggccuccuucaucgaggucaagaccugcaucuggcccaagagccacacgcucugguccaacggcgugcuggagagcgagaugaucauccccaagaucuacggcgggccgaucucccagcacaacuaccgccccggcuacuucacccagaccgccgggcccuggcaccugggcaagcucgagcuggacuucgaccugugcgaggggaccacgguggucguggacgagcacugcggcaaccggggcccgagccuccgcaccaccaccgugacggggaagaucauccacgaguggugcugccgguccugcacccugccgccccugcgcuuccggggcgaggacgggugcugguacggcauggagauccgccccgucaaggagaaggaggagaaccucgucaagagcauggugagcgccggguccggcgaggucgacagcuucucccugggccugcucugcaucagcaucaugaucgaggaggugaugcggucccgcuggagccggaagaugcugaugaccgggacccuggccguguucuuccuccugaucaugggccagcugacguggaacgaccucauccgccugugcaucauggucggggcgaacgccuccgaccgcaugggcauggggaccaccuaccuggcccucauggccaccuucaagaugcggccgauguucgccgugggccugcuguuccgccggcucacgagccgcgaggugcugcugcucaccaucggccugucccuggucgcgagcguggagcuccccaacucccuggaggagcugggggacggccucgccauggggaucaugauccugaagcugcucaccgacuuccagagccaccagcugugggccacccugcucucccugacguucaucaagaccaccuucagccugcacuacgccuggaagaccauggcgaugguccucuccaucgugagccuguucccccugugccucuccacgaccagccagaagaccaccuggcugcccgugcugcucggcucccugggcugcaagccgcugacgauguuccucaucgccgagaacaagaucugggggcgcaagagcuggccccugaacgagggcaucauggccgucgggaucgugagcauccugcucuccagccugcugaagaacgacgugccccucgccggcccccugaucgccgggggcaugcugaucgcgugcuacgucaucuccggcagcuccgccgaccucagccuggagaaggccgccgagguguccugggaggaggaggccgagcacagcggggcgucccacaacauccugguggagguccaggacgacggcaccaugaagaucaaggacgaggagcgcgacgacacccucaccauccugcugaaggccacccuccuggccgugagcgggguguacccgcuguccauccccgccacccucuucgucugguacuucuggcagaagaagaagcagcggagcggcgugcugugggacacccccagcccgcccgagguggagcgcgccguccuggacgacgggaucuaccggaucaugcagcgcggccugcucggccggagccaggugggggugggcgucuuccaggagaacguguuccacaccauguggcacgugacccgcggggcgguccugauguaccagggcaagcggcuggagcccuccugggccagcgugaagaaggaccucaucuccuacgggggcggcuggcgccugcaggggagcuggaacacgggcgaggaggugcaggucaucgccguggagcccgggaagaaccccaagaacgugcagaccgcccccggcaccuucaagacccccgagggggaggucggcgccaucgcgcuggacuucaagcccggcacguccgggagccccaucgugaaccgggagggcaagaucguggggcucuacggcaacggcgucgugaccaccagcgggaccuacguguccgccaucgcccaggccaaggcgagccaggagggcccgcugcccgagaucgaggacgaggucuuccgcaagcggaaccugacgaucauggaccuccaccccggguccggcaagacccgccgguaccugccggccaucgugcgcgaggccaucaagcggaagcugcgcacccucauccuggcccccacccgcguggucgccagcgagauggcggaggcccugaaggggaugcccauccgguaccagacgaccgccgugaaguccgagcacaccggcaaggagaucguggaccucaugugccacgccaccuucacgaugcgccugcugagccccguccgggugccgaacuacaacaugaucaucauggacgaggcccacuucaccgaccccuccagcaucgcggcccgcggcuacaucuccacccggguggggaugggcgaggccgccgccaucuucaugaccgcgacgccgcccgggagcgucgaggccuucccgcaguccaacgccgugauccaggacgaggagcgcgacauccccgagcggagcuggaacuccggcuacgaguggaucaccgacuuccccgggaagaccgugugguucguccccagcaucaaguccggcaacgacaucgccaacugccuccgcaagaacggcaagcgggugauccagcugagccgcaagaccuucgacacggaguaccagaagaccaagaacaacgacugggacuacguggucaccaccgacaucuccgagaugggggcgaacuuccgggccgaccgcgugaucgacccgcggcgcugccugaagcccgugauccucaaggacggccccgagcgggucauccuggccgggcccaugccggugacggucgccagcgccgcgcagcgccggggccgcaucgggcggaaccacaacaaggagggcgaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgaucgacggcgaguaccgccuccgcggggaggcccgcaagaccuucguggagcugaugcggcgcggcgaccugcccguguggcucagcuacaaggucgccagcgagggguuccaguacuccgaccggcgcuggugcuucgacggcgagcggaacaaccaggugcuggaggagaacauggacguggagaucuggacgaaggagggcgagcgcaagaagcugcggccccgcuggcucgacgcccggaccuacagcgacccccuggcccugcgcgaguucaaggaguucgcggccgggcggcgcuccgucagcggcgaccucauccuggagaucgggaagcugccgcagcaccucacccagcgggcccagaacgcccuggacaaccuggugaugcuccacaacuccgagcagggcggccgcgcguaccggcacgccauggaggagcugcccgacaccaucgagacgcugaugcuccuggcccugaucgccgugcucaccgggggcgucacccuguucuuccugagcgggcgcggccucgggaagaccuccaucggccugcugugcgugauggccagcuccgugcuccuguggauggcgagcgucgagccccacuggaucgccgccuccaucauccuggaguucuuccucauggugcugcugauccccgagccggaccggcagcgcacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccagcgcguggacccucuacgccguggccacgaccaucaucaccccgaugaugcggcacaccaucgagaacacgaccgccaacaucucccugaccgccaucgcgaaccaggccgccauccugaugggccucgacaagggguggcccaucagcaagauggacaucggcgucccccugcuggcccucggcugcuacucccaggugaacccccugacccugacggcggccgugcucaugcuggucgcccacuacgccaucaucgggccgggccugcaggccaaggcgacccgcgaggcccagaagcgcaccgccgccgggaucaugaagaaccccaccguggacggcaucguggccaucgaccucgaccccgucguguacgacgcgaaguucgagaagcagcuggggcagaucaugcugcucauccugugcacgagccagauccugcucaugcggaccaccugggcccugugcgaguccaucacccuggccacgggcccccucaccacccugugggagggcagcccggggaaguucuggaacaccacgaucgccguguccauggccaacaucuuccgcggcagcuaccuggcgggggccggccucgccuucagccugaugaagucccugggcgggggccggcgcgggaccggcgcccagggggagacccucggcgagaaguggaagcggcagcugaaccagcugagcaaguccgaguucaacaccuacaagcgcagcggcaucauggaggucgaccgguccgaggcgaaggaggggcucaagcgcggcgagacgaccaagcacgccgugagccgggggaccgccaagcugcgcugguucguggagcggaaccuggucaagcccgagggcaaggugaucgaccuggggugcggccgcggcgggugguccuacuacugcgccggccucaagaaggugaccgaggucaagggguacacgaagggcgggcccggccacgaggagcccaucccgauggccaccuacggcuggaaccuggugaagcugcacagcgggaaggacgcguucuucaucccgcccgagaagugcgacacccuccugugcgacaucggcgaguccagccccaacccgaccaucgaggaggggcggacgcugcgcgugcucaagauggucgagcccuggcugcggggcaaccaguucugcaucaagauccugaaccccuacaugcccuccgugguggagacccucgagcagaugcagcgcaagcacgggggcaugcugguccggaacccgcugagccgcaacuccacccacgagauguacugggugagcugcggcaccgggaacaucguguccgccgucaacaugaccagccggaugcuccugaaccgcuucacgauggcccaccgcaagcccaccuacgagcgggacguggaccugggcaccgggacccgccacguggccgucgagcccgagguggccaaccucgacaucaucggccagcggaucgagaacaucaagcacgagcacaaguccacguggcacuacgacgaggacaaccccuacaagaccugggcguaccacggcagcuacgaggugaagccguccgggagcgccagcuccauggucaacggcguggucaagcugcugaccaagcccugggacgugauccccauggugacccagaucgccaugacggacaccacccccuucgggcagcagcgcgucuucaaggagaagguggacacccggacgccgaaggccaagcgcggcaccgcccagaucauggaggugaccgcgcgguggcucuggggguuccugagccgcaacaagaagccccggaucugcacccgcgaggaguucacgcggaagguccgcuccaacgccgccaucggcgccguguucguggacgagaaccaguggaacagcgcgaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggggcgcgcuuccucgaguucgaggcccugggcuucaugaacgaggaccacugguucagccgggagaacucccugagcggcgucgagggggagggccuccacaagcugggguacauccugcgcgacaucuccaagauccccggcgggaacauguacgccgacgacaccgccggcugggacacccggaucacggaggacgaccuccagaacgaggccaagaucaccgacaucauggagccggagcacgcgcugcuggccaaggccaucuucaagcucaccuaccagaacaagguggugcgcguccagcgccccgccaagaacggcaccgugauggacgugaucagccggcgcgaccagcggggguccggccaggucgggacguacggccugaacaccuucaccaacauggaggcccagcugauccgccagauggagagcgagggcaucuucucccccagcgagcucgagacccccaaccuggcggagcgggcccuggacuggcucgagaaguacgggguggagcgccugaagcggauggccaucuccggcgacgacugcguggucaagccgaucgacgaccgcuucgccacggcccugaccgcgcucaacgacauggggaaggugcggaaggacaucccccagugggagcccagcaagggcuggaacgacuggcagcagguccccuucugcucccaccacuuccaccagcugaucaugaaggacgggcgcgagaucgucgugccgugccggaaccaggacgagcuggugggccgcgcccgggucagccagggcgccggguggagccuccgcgagaccgccugccugggcaaguccuacgcgcagauguggcagcugauguacuuccaccggcgcgaccuccggcuggccgccaacgccaucugcagcgccgugcccguggacuggguccccaccucccgcacgaccuggagcauccacgcgcaccaccaguggaugaccaccgaggacaugcuguccguguggaaccggguguggaucgaggagaaccccuggauggaggacaagacgcacaucagcuccugggaggacgucccguaccucgggaagcgcgaggaccaguggugcggcagccugaucgggcugaccgcccgcgccaccugggccaccaacauccagguggccaucaaccaggugcggcgccucaucggcaacgagaacuaccuggacuacaugaccuccaugaagcgguucaagaacgagagcgaccccgagggcgcgcugugguga

SEQ ID NO: 8012 - RNA, 9879 nt, Artificial Sequence
  derived and/or modified CDS sequence (opt1) from DENV-1__FJ639673__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagguggagcccgacgacgucgacugcuggugcaacaccaccgacaccugggugaccuacgggaccugcagccagacgggcgagcaccggcgcgacaagcggagcguggcccucgcgccccacgucggccuggggcuggagacccgcgccgagaccuggaugagcuccgagggcgcguggaagcagauccagcggguggagaccugggcccuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccggcaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccgccucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccggcgcauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgggagcucaagugcgggagcggcaucuucgugaccaacgagguccacacguggaccgagcaguacaaguuccaggccgacuccccgaagcgccugagcgcggccaucggcaaggccugggaggagggggugugcggcauccgguccgccacccgccuggagaacaucauguggcggcagaucagcaacgagcucaaccacauccugcuggagaacgacaugaaguucaccguggucgugggggacguggucggcauccucgcccaggggaagaagaugauccgcccccagcccauggagcacaaguacuccuggaaguccuggggcaaggcgaagaucaucggcgccgacgugcagaacaccacguucaucaucgacgggcccaacaccccggagugccccgacgaccagcgggccuggaacaucugggagguggaggacuacggcuucgggaucuucaccaccaacaucuggcugaagcugcgcgacuccuacacgcaggucugcgaccaccggcucaugagcgccgcgaucaaggacuccaaggccgugcacgccgacaugggcuacuggaucgagagcgagaagaacgagaccuggaagcuggcccgcgccuccuucaucgaggugaagaccugcaucuggcccaagagccacacccugugguccaacggcguccucgagagcgagaugaucauccccaagaucuacgggggcccgaucucccagcacaacuaccggcccggguacuucacgcagaccgcgggccccuggcaccuggggaagcuggagcucgacuucgaccugugcgagggcaccaccgugguggucgacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgugaaggagaaggaggagaaccuggucaagagcauggugagcgccggcuccggcgagguggacagcuucucccucgggcugcugugcaucagcaucaugaucgaggaggucaugcggucccgcuggagccggaagaugcucaugaccggcacccuggccguguucuuccugcucaucauggggcagcugaccuggaacgaccugauccgcuccugcaucauggugggcgccaacgccagcgaccgcauggggaugggcacgaccuaccucgcgcugauggccaccuucaagaugcggccgauguucgccgucggccugcuguuccgccggcugaccucccgcgaggugcugcuccugacgaucgggcugagccucgucgccuccguggagcugcccaacagccuggaggagcucggcgacgggcuggccaugggcaucaugauccugaagcuccugaccgacuuccaguccuaccagcugugggcgacccuccugagccugaccuucaucaagacgaccuucucccuccacuacgccuggaagaccauggccauggugcugagcaucgucucccugcucccccugugccugagcaccacgucccagaagaccaccuggcuccccgugcugcugggcagccucgggugcaagccgcugaccauguuccugaucgccgagaacaagaucuggggccgcaagagcuggccccucaacgaggggaucauggcggugggcaucgucuccauccugcugagcucccuccugaagaacgacgugccccuggccgggccccucaucgccggcggcaugcugaucgccugcuacgugaucagcggguccagcgccgaccugucccucgagaaggcggccgucgugagcugggaggaggaggccgagcacuccggcgccagccacaacauccugguggagguccaggacgacgggacgaugaagaucaaggacgaggagcgcgacgacacccugaccauccuccugaaggccacccugcucgcgguguccggcguguacccgcugagcauccccgccacccuguucgucugguacuucuggcagaagaagaagcagcgguccggggugcucugggacacgcccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgccguccucauguaccaggggaagcggcuggagcccagcugggccuccgugaagaaggaccugaucagcuacggcggcggguggcgccuccagggcuccuggaacaccggggaggaggugcaggucaucgcgguggagcccggcaagaaccccaagaacgugcagacggcccccgggaccuucaagacccccgagggcgaggucggcgccaucgcccuggacuucaagcccgggaccagcggcagccccaucgugaaccgggaggggaagaucgugggccuguacggcaacggggucgugacgaccuccggcaccuacgugagcgccaucgcgcaggccaaggccucccaggaggggccgcuccccgagaucgaggacgaggucuuccgcaagcggaaccugaccaucauggaccugcaccccggcagcgggaagacgcgccgguaccucccggccaucgugcgcgaggcgaucaagcggaagcugcgcacccugauccucgcccccacccgcguggucgccuccgagauggccgaggcccugaagggcaugcccauccgguaccagaccacggcggucaagagcgagcacaccggccgcgagaucguggaccugaugugccacgccaccuucaccaugcggcuccugucccccguccgcgugccgaacuacaacaugaucaucauggacgaggcccacuucacggaccccagcuccaucgccgcccggggguacaucagcacccgcgugggcaugggggaggcggccgccaucuucaugaccgccacgccgcccggcuccgucgaggccuucccgcagagcaacgcggugauccaggacgaggagcgggacauccccgagcgcuccuggaacagcggguacgaguggaucacggacuuccccggcaagaccgugugguucguccccuccaucaagagcggcaacgacaucgccaacugccugcggaagaacgggaagcgcgugauccagcucucccggaagaccuucgacaccgaguaccagaagacgaagaacaacgacugggacuacguggucaccaccgacaucagcgagaugggcgccaacuuccgcgccgaccgggugaucgacccgcgccggugccugaagcccgucauccugaaggacgggcccgagcgcgugauccucgcgggccccaugccggugaccgucgccuccgccgcccagcggcgcgggcggaucggccgcaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccggcugcgcggcgaggcccggaagaccuucguggagcucaugcgccgcggggaccugcccguguggcugagcuacaaggucgcguccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcacguacuccgacccccucgcccugcgggaguucaaggaguucgccgccggccgccggagcgucuccggggaccugauccucgagaucggcaagcugccgcagcaccugacccagcgcgcgcagaacgcccucgacaaccuggugaugcugcacaacagcgagcagggcgggcgggccuaccgccacgccauggaggagcuccccgacaccaucgagacccugaugcugcucgcgcugaucgccgugcugacgggcggggucacccucuucuuccuguccggccgggggcugggcaagaccagcaucggccuccugugcgugauggccuccagcgcccugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagacgaccaagaaggaccuggggaucggccacguggcgguggagaaccaccaccacgccaccaugcucgacgucgaccugcaccccgccuccgccuggacccuguacgccguggcgacgaccaucaucaccccgaugaugcgccacaccaucgagaacacgaccgccaacaucagccucaccgccaucgccaaccaggccgcgauccugauggggcuggacaagggcuggcccaucuccaagauggacaucggcgugccccuccuggcccuggggugcuacagccaggucaacccccucacccugacggccgccgugcugaugcucguggcgcacuacgccaucaucggcccggggcugcaggccaaggccacccgcgaggcccagaagcggaccgcggccggcaucaugaagaaccccaccgucgacgggaucguggccaucgaccuggaccccguggucuacgacgccaaguucgagaagcagcucggccagaucaugcugcugauccucugcacgucccagauccugcugaugcgcaccaccugggcccucugcgagagcaucacccuggcgacgggcccccugaccacccucugggagggguccccgggcaaguucuggaacaccacgaucgccgugagcauggccaacaucuuccgggggagcuaccuggccggcgccggccuggcguucucccucaugaagucccucgggggcgggcgccgggggaccggggcccagggcgagacccugggcgagaaguggaagcgccagcucaaccagcuguccaagagcgaguucaacaccuacaagcgguccgggaucauggagguggaccgcagcgaggccaaggagggccugcggcgcggggagacgaccaagcacgccgucucccggggcaccgcgaagcuccgcugguucguggagcggaaccuggugaagcccgaggggaaggucaucgaccugggcugcggccgcgggggcuggagcuacuacugcgccgggcugaagaaggugaccgaggugaagggcuacacgaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgaccaucgaggagggccggacgcugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggaccggcaacaucgugagcgccgucaacaugaccucccgcaugcugcucaaccgguucacgauggcccaccgcaagcccaccuacgagcgggacguggaccugggggcgggcacccgccacguggccgucgagcccgagguggccaaccuggacaucaucggccagcggaucgagaacaucaagcacgagcacaagagcaccuggcacuacgacgaggacaaccccuacaagacgugggccuaccacggguccuacgaggucaagccgagcggcagcgccuccagcauggugaacgggguggucaagcuccugaccaagcccugggacgugauccccauggugacccagaucgcgaugaccgacacgacccccuucggccagcagcgcgucuucaaggagaagguggacacccggaccccgaaggccaagcgcgggacggcccagaucauggaggugaccgcccgguggcuguggggcuuccucucccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccuggugcaccgcgagcgggagcugcacaagcaggggaagugcgcgacgugcguguacaacaugaugggcaagcgcgagaagaagcucggggaguucggcaaggccaaggggagccgggccaucugguacauguggcugggcgcccgcuuccuggaguucgaggcccucggcuucaugaacgaggaccacugguucucccgggagaacagccuguccggggucgagggcgaggggcugcacaagcucggcuacauccugcgcgacaucagcaagauccccgggggcaacauguacgcggacgacaccgccggcugggacacccgcaucaccgaggacgaccugcagaacgaggccaagaucacggacaucauggagccggagcacgcccuccuggccaccuccaucuucaagcugaccuaccagaacaagguggugcggguccagcgccccgcgaagaacgggaccgugauggacgugaucagccggcgcgaccagcggggcuccgggcaggucggcacguacggccucaacaccuucaccaacauggaggcccagcugauccgccagauggagagcgaggggaucuucucccccagcgagcuggagacccccaaccucgccgagcgggugcuggacuggcuggagaaguacggcguggagcgccucaagcggauggccaucuccggggacgacugcgucgugaagccgaucgacgaccgcuucgccacggcgcugaccgcccugaacgacaugggcaaggugcggaaggacaucccccagugggagcccagcaagggguggaacgacuggcagcagguccccuucugcagccaccacuuccaccagcucaucaugaaggacggccgcgagaucguggugccgugccggaaccaggacgagcuggucggccgcgcccgggugucccagggggccggcuggagccugcgcgagaccgccugccucgggaaguccuacgcgcagauguggcagcugauguacuuccaccggcgcgaccugcggcucgccgccaacgccaucugcagcgcggugcccgucgacugggugcccaccucccgcacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccuggggaagcgggaggaccaguggugcggcagccucaucggccugaccgcccgcgccaccugggccaccaacauccagguggcgaucaaccagguccggcgccugaucgggaacgagaacuaccucgacuacaugaccuccaugaagcgguucaagaacgagagcgaccccgagggcgcccugugguga

SEQ ID NO: 8013 - RNA, 9879 nt, Artificial Sequence
  derived and/or modified CDS sequence (opt1) from DENV-1__FJ639674__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacaccugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccaugagccuguccaugacgugcaucgccguggggcuggucacccucuaccugggcgugauggugcaggccgacagcgggugcgucaucaacuggaagggccgggagcugaagugcgggagcggcaucuucgugaccaacgaggugcacaccuggacggagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagacguggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacccagacggccggccccuggcaccucgggaagcuggagcuggacuucgaccucugcgagggcaccaccguggucguggacgagcacugcggcaaccgggggccgagccugcgcaccacgaccgugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugacgggcacccucgccguguucuuccugcugaucauggggcagcucaccuggaacgaccugauccggcugugcaucauggucggcgcgaacgccuccgaccgcauggggaugggcaccacguaccucgcccugauggccaccuucaagaugcgcccgauguucgccguggggcuccuguuccggcgccugaccagccgggaggugcugcuccugaccaucgggcugucccucgucgcgagcguggagcugcccaacucccuggaggagcucggcgacgggcuggccaugggcaucaugauccugaagcuccugacggacuuccagagccaccagcugugggccacccuccugucccugaccuucaucaagaccacguucagccuccacuacgccuggaagaccauggcgaugguccuguccaucgugagccuguucccccucugccuguccaccaccagccagaagacgaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacgcugaccauccugcucaaggccacccugcuggccgugagcggcguguacccgcucuccauccccgccacccuguucgucugguacuucuggcagaagaagaagcagcgcagcggggugcugugggacacccccagcccgcccgagguggagcgggccguccucgacgacggcaucuaccgcaucaugcagcggggccugcuggggcgcagccaggugggcgugggggucuuccaggagaacguguuccacacgauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagaccgcccccgggacguucaagaccuccgagggcgaggucggcgccaucgcgcucgacuucaagcccgggaccagcggcagccccaucgugaaccgcgaggggaagaucgugggccuguacggcaacggggucgugaccacguccggcaccuacgugagcgccaucgcccaggccaaggcgucccaggaggggccccugccggagaucgaggacgaggucuuccggaagcgcaaccucaccaucauggaccugcaccccggcagcgggaagacccggcgcuaccugcccgccaucgugcgggaggccaucaagcgcaagcuccggacgcugauccuggccccgacccgcguggucgccuccgagauggcggaggcccucaagggcaugcccauccgcuaccagaccaccgccgucaagagcgagcacacgggcaaggagaucguggaccugaugugccacgccaccuucaccaugcggcugcucucccccguccgcgugcccaacuacaacaugaucaucauggacgaggcccacuucaccgacccgagcuccaucgcggcccggggguacaucagcacgcgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccugcggaagaacgggaagcgcgugauccagcugucccggaagaccuucgacaccgaguaccagaagaccaagaacaacgacugggacuacguggucacgaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacgcccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcaccuacuccgacccccuggcccuccgggaguucaaggaguucgcggccggccgccggagcgucuccggggaccugauccuggagaucggcaagcucccccagcaccugacgcagcgcgcccagaacgcccuggacaaccucgugaugcugcacaacagcgagcagggcgggcgggcguaccgccacgccauggaggagcugccggacaccaucgagacccucaugcugcuggcccucaucgccgugcugaccggcggggucacgcuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccacgaagaaggaccuggggaucggccacguggccgucgagaaccaccaccacgccgccaugcuggacguggaccuccaccccgccuccgcguggacccuguacgccguggccaccaccaucaucacgcccaugaugcgccacaccaucgagaacaccaccgccaacaucagccugacggccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacccgggaggcccagaagcgcacggccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggccaacaucuuccgggggagcuaccucgcgggcgccggccuggccuucucccugaugaagucccucgggggcgggcgccggggcaccggggcccagggcgagacgcugggcgagaaguggaagcgccagcugaaccagcucuccaagagcgaguucaacaccuacaagcgguccgggaucauggaggucgaccgcagcgaggcgaaggagggccugaagcgcggggagaccaccaagcacgccgugucccgcggcacggccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccaccuacggguggaaccuggugaagcuccacuccggcaaggacguguucuucaucccgcccgagaagugcgacacgcugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacccuggagcagaugcagcggaagcacggcggcaugcuggugcgcaacccccucucccggaacagcacgcacgagauguacuggguguccugcgggaccggcaacaucgucagcgcggugaacaugaccucccgcaugcugcugaaccgguucaccauggcccaccgcaagccgaccuacgagcgcgacguggaccucggggccggcacgcggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgcgaaguggcuguggggcuuccugucccgcaacaagaagccgcggaucugcacgcgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacaccgccggcugggacacgcggaucaccgaggacgaccugcagaacgaggccaagaucaccgacaucauggagcccgagcacgcgcugcucgccaaguccaucuucaagcugaccuaccagaacaaggugguccgcgugcagcggccggugaagaacgggacggucauggacgugaucagccgccgcgaccagcggggcuccggccaggugggcaccuacggccugaacaccuucaccaacauggaggcccagcucauccgccagauggagagcgaggggaucuucucccccagcgagcuggagacgcccaaccuggccggccggguccucgacuggcuggagaagcacgggguggagcgccugaagcggauggccaucuccggcgacgacugcguggucaagcccaucgacgaccgcuucgcgaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgccggguggagccugcgcgagaccgcgugccugggcaaguccuacgcccagauguggcagcucauguacuuccaccggcgcgaccugcggcuggccgccaacgcgaucugcagcgccgugccgguggacuggguccccacgucccgcaccaccuggagcauccacgcccaccaccaguggaugaccacggaggacaugcucuccguguggaaccggguguggaucgaggagaaccccuggauggaggacaagacccacaucagcuccuggggcgacguccccuaccugggcaagcgcgaggaccaguggugcggcagccugaucgggcucaccgcccgggccaccugggcgacgaacauccagguggccaucaaccaggugcgccgccugaucggcaacgagaacuaccuggacuacaugaccuccaugaagcgguucaagaacgagagcgacccggagggggcccucugguga

SEQ ID NO: 8014 - RNA, 9879 nt, Artificial Sequence
  derived and/or modified CDS sequence (opt1) from DENV-1__FJ639675__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggcuguucaagcucgagaaggagguggcggagacccagcacggcacggugcugguccagaucaaguacgagggcaccgacgcccccugcaagauccccuucagcacccaggacgagaagggggugacccagaacggccggcugaucacggccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcgucgggaagcuggugcaccagaucuucggcaccgccuacggggugcuguucuccggcgucagcuggaccaugaagaucgggaucggcgugcugcugaccuggcucggccugaacucccgcagcacgucccugagcaugaccugcaucgccguggggcucgucacccuguaccugggcgugauggugcaggccgacuccgggugcgucaucaacuggaagggccgggagcucaagugcgggagcggcaucuucgugaccaacgaggugcacacguggaccgagcaguacaaguuccaggcggacagcccgaagcgccuguccagcgccaucggcaaggccugggaggagggggucugcggcauccgguccgccacccgccuggagaacaucauguggaagcagaucagcaacgagcucaaccacauccugcuggagaacgacaugaaguucaccgugguggucggggacguggccggcauccucgcgcaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgccuggaacaucugggaggucgaggacuacggcuucgggaucuucaccaccaacaucuggcugaagcugcgggacuccuacacccaggugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcaucuggcccaagagccacacccugugguccaacggcgugcucgagagcgagaugaucauccccaagaucuacgggggcccgaucucccagcacaacuaccgccccggguacuucacgcagaccgccggccccuggcaccuggggaagcuggagcucgacuucgaccugugcgagggcaccaccguggucguggacgagcacugcggcaaccgggggccgagccugcgcacgaccaccgugaccggcaagaucauccacgaguggugcugccgguccugcacgcugccgccccuccgcuucaagggggaggacggcugcugguacgggauggagauccggcccgucaaggagaaggaggagaaccuggucaagagcauggugagcgccggcuccggcgaggucgacagcuucucccucgggcugcugugcaucagcaucaugaucgaggaggugaugcgcucccgguggagccgcaagaugcucaugaccggcacccuggccguguucuuccugcucaucauggggcagcugaccuggaacgaccugauccggcucugcaucauggucggcgccaacgcguccgaccgcauggggaugggcaugacguaccuggcccugauggccaccuucaagaugcgcccgauguucgccgugggccuccuguuccggcgccugaccagccgggaggugcuccugcugaccaucgggcucucccuggucgccagcguggagcugcccaacucccucgaggagcugggcgacgggcuggcgaugggcaucaugauccucaagcugcugacggacuuccagagccaccagcucugggccacccugcugucccucaccuucaucaagaccacguucagccugcacuacgccuggaagaccauggccaugguccuguccaucgugagccucuucccccugugccuguccaccaccagccagaagacgaccuggcuccccgugcugcugggcucccucgggugcaagccgcugaccauguuccugaucgcggagaacaagaucuggggccgcaagagcuggccccucaacgaggggaucauggccgucggcaucgugagcauccugcuguccagccuccugaagaacgacgugccccuggccgggccccucaucgccggcggcaugcugaucgccugcuacgucaucuccgggagcuccgcggaccugagccucgagaaggccgccgagguguccugggaggaggaggccgagcacagcggcgccucccacaacauccugguggagguccaggacgacgggaccaugaagaucaaggacgaggagcgggacgacacgcugaccauccuccugaaggcgacccugcucgccgugagcggcguguacccgcuguccauccccgccacccuguucgucugguacuucuggcagaagaagaagcagcgcagcggggugcucugggacacccccagcccgcccgagguggagcgggccguccuggacgacggcaucuaccgcaucaugcagcggggccugcuggggcgcagccaggugggcgugggggucuuccaggagaacguguuccacacgauguggcacgugacccggggcgccguccucauguaccaggggaagcgccuggagcccuccugggcgagcgugaagaaggaccugaucuccuacggcggcggguggcggcuccagggcagcuggaacaccggggaggaggugcaggucaucgccguggagcccggcaagaaccccaagaacgugcagaccgcccccgggacguucaagaccuccgagggcgaggucggcgccaucgcccuggacuucaagcccgggaccagcggcagccccaucgugaaccgcgaggggaagaucgugggccuguacggcaacggggucgugaccacguccggcaccuacgugagcgcgaucgcccaggccaaggccucccaggaggggccccucccggagaucgaggacgaggucuuccggaagcgcaaccugaccaucauggaccugcaccccggcagcgggaagacccggcgcuaccuccccgcgaucgugcgggaggccaucaagcgcaagcugcggacgcugauccucgccccgacccgcguggucgccuccgagauggccgaggcgcugaagggcaugcccauccgcuaccagaccaccgccgucaagagcgagcacacgggcaaggagaucguggaccugaugugccacgccaccuucaccaugcggcuccugucccccguccgcgugcccaacuacaacaugaucaucauggacgaggcccacuucaccgacccgagcuccaucgccgcgcggggguacaucagcacgcgcgugggcaugggggaggccgccgccaucuucaugaccgccacgccgcccggcuccgucgaggcguucccccagagcaacgccgugauccaggacgaggagcgggacaucccggagcgcuccuggaacagcggguacgaguggaucaccgacuuccccggcaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgccaacuuccgcgcggaccgggugaucgacccccgccggugccugaagccggugauccugaaggacgggcccgagcgcgucauccucgccggccccaugcccgugaccgucgccuccgccgcccagcggcgcgggcggaucggccgcaaccacaacaaggagggcgaccaguacaucuacauggggcagccgcugaacaacgacgaggaccacgcgcacuggaccgaggccaagaugcugcucgacaacaucaacacgcccgagggcaucauccccgcccuguucgagcccgagcgggagaaguccgccgccaucgacggggaguaccgccugcgcggcgaggcgcggaagaccuucguggagcucaugcgccgcggggaccugccgguguggcugagcuacaaggucgccuccgagggcuuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcgucuccggggaccugauccucgagaucggcaagcugccccagcaccugacgcagcgcgcccagaacgcccucgacaaccuggugaugcugcacaacagcgagcagggcgggcgggccuaccgccacgcgauggaggagcucccggacaccaucgagacccugaugcugcucgcccugaucgccgugcugaccggcggggucacccucuucuuccuguccggccgggggcugggcaagacgagcaucggccuccugugcgugauggccuccagcgugcugcucuggauggccuccgucgagccccacuggaucgcggccagcaucauccuggaguucuuccugauggugcuccugauccccgagcccgaccgccagcggaccccgcaggacaaccagcuggccuacguggucaucgggcuccuguucaugauccugaccguggccgccaacgagaugggccuccuggagaccacgaagaaggaccuggggaucggccacguggcggucgagaaccaccaccacgccgccaugcucgacguggaccugcaccccgccuccgccuggacccuguacgcgguggccaccaccaucaucacgcccaugaugcgccacaccaucgagaacaccaccgccaacaucagccucacggccaucgccaaccaggcggccauccugauggggcuggacaagggcuggccgaucuccaagauggacaucggcgucccccuccuggcccuggggugcuacagccaggugaacccccucacccugaccgccgcggugcugaugcucgucgcccacuacgccaucaucggccccgggcugcaggccaaggccacccgggaggcgcagaagcgcacggccgccggcaucaugaagaacccgaccguggacgggaucguggccaucgaccuggaccccgucguguacgacgccaaguucgagaagcagcucggccagaucaugcugcugauccucugcaccucccagauccugcugaugcgcaccacgugggcgcucugcgagagcaucacccuggccaccggcccccugaccacgcucugggaggggucccccggcaaguucuggaacaccaccaucgccgugagcauggccaacaucuuccgggggagcuaccuggccggcgcgggccuggccuucucccucaugaagucccucgggggcgggcgccgggggaccggggcccagggcgagacgcugggcgagaaguggaagcgccagcucaaccagcuguccaagagcgaguucaacaccuacaagcgguccgggaucauggaggucgaccgcagcgaggccaaggagggccugaagcgcggggagaccaccaagcacgcggugucccgcggcacggccaagcuccggugguucguggagcgcaaccuggucaagccggaggggaaggugaucgaccugggcugcggccgcggcggguggagcuacuacugcgccgggcugaagaaggugaccgaggucaagggguacaccaagggcggccccggccacgaggagcccauccccauggccaccuacggguggaaccucgugaagcugcacuccggcaaggacguguucuucaucccgcccgagaagugcgacacgcugcucugcgacaucggggagagcucccccaaccccaccaucgaggagggccgcacccugcggguccugaagaugguggagccguggcuccgcgggaaccaguucugcaucaagauccugaaccccuacaugcccagcguggucgagacccuggagcagaugcagcggaagcacggcggcaugcucgugcgcaacccccugucccggaacagcacgcacgagauguacuggguguccugcgggaccggcaacaucgucagcgccgugaacaugaccucccgcaugcugcucaaccgguucaccauggcgcaccgcaagccgaccuacgagcgcgacguggaccugggggccggcacgcggcacgucgccguggagcccgagguggccaaccuggacaucaucggccagcgcaucgagaacaucaagcacgagcacaagagcaccuggcacuacgacgaggacaaccccuacaagaccugggccuaccacggguccuacgaggucaagcccagcggcagcgcguccagcauggugaacggggucgugaagcuccugaccaagccgugggacgugauccccauggucacgcagaucgccaugaccgacaccacccccuucggccagcagcggguguucaaggagaagguggacacgcgcacccccaaggccaagcgggggaccgcccagaucauggaggucaccgccaaguggcuguggggcuuccucucccgcaacaagaagccgcggaucugcacgcgcgaggaguucacccggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacgcggaucaccgaggacgaccugcagaacgaggccaagaucaccgacaucauggagcccgagcacgcccuccuggcgaaguccaucuucaagcugaccuaccagaacaaggugguccgcgugcagcggccggccaagaacgggacggugauggacgucaucagccgccgcgaccagcggggcuccggccaggugggcaccuacggccucaacaccuucaccaacauggaggcccagcugauccgccagauggagagcgaggggaucuucucccccagcgagcuggagacgcccaaccucgccgagcgggugcuggacuggcuggagaagcacggcgucgagcgccucaagcggauggccaucuccggggacgacugcguggugaagcccaucgacgaccgcuucgcgaccgcccugaccgcccugaacgacaugggcaagguccggaaggacaucccgcagugggagcccagcaagggguggaacgacuggcagcagguccccuucugcagccaccacuuccaccagcucaucaugaaggacggccgcgagaucgugguccccugccggaaccaggacgagcuggugggccgcgcccgggugucccagggggccggcuggagccugcgcgagaccgcgugccucgggaaguccuacgcccagauguggcagcugauguacuuccaccggcgcgaccugcggcucgccgccaacgcgaucugcagcgccgucccgguggacugggugcccacgucccgcaccaccuggagcauccacgcccaccaccaguggaugaccacggaggacaugcuguccgucuggaaccggguguggaucgaggagaaccccuggauggaggacaagacccacaucagcuccuggggcgacgugcccuaccuggggaagcgcgaggaccaguggugcggcagccucaucggccugaccgcccgggccaccugggcgacgaacauccaggucgccaucaaccaggugcgccgccugaucgggaacgagaacuaccucgacuacaugaccuccaugaagcgguucaagaacgagagcgacccggagggcgcccugugguga

SEQ ID NO: 8015 - RNA, 9879 nt, Artificial Sequence
  derived and/or modified CDS sequence (opt1) from DENV-1__FJ639676__SS-prME
agcgugaccaugcugcugaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccgcaucaccgagguggagcccgacgacgucgacugcuggugcaacaccaccgacaccugggugaccuacgggaccugcagccagacgggcgagcaccggcgcgacaagcgguccguggcccucgcgccccacgccggccuggggcuggagacccgcgcggagaccuggaugagcuccgagggcgccuggaagcagauccagcgggucgagaccugggcccuccgccaccccggguucacggugaucgcccuguuccuggcgcacgugaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccgugcugcggaagcucugcaucgaggcgaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgccaccaucacgccccaggcgcccacgagcgagauccagcucaccgacuacggggcccugacccuggacugcagcccccggaccggccucgacuucaacgagauggugcugcugacgaugaaggagaaguccuggcucgugcacaagcagugguuccuggaccugccccuccccuggaccagcggggccuccaccagccaggagaccuggaaccggcaggaccugcuggucacguucaagaccgcccacgccaagaagcaggagguggugguccucggcucccaggagggcgcgaugcacaccgcccugaccggggccacggagauccagaccagcggcaccaccacgaucuucgccgggcaccugaagugccgccucaagauggacaagcugacccugaagggcauguccuacgugaugugcaccgggagcuucaagcucgagaaggagguggccgagacccagcacggcacgguccuggugcagaucaaguacgagggcaccgacgcgcccugcaagauccccuucuccacccaggacgagaagggggugacccagaacggccggcugaucacggccaacccgaucgucaccgacaaggagaagcccgugaacaucgaggccgagccgcccuucggggagagcuacaucgugaucggcgccggcgagaaggcgcugaagcucuccugguucaagaaggggagcuccaucggcaagauguucgaggccaccgcccgcggggcccggcgcauggccauccugggcgacaccgcgugggacuucgggagcaucggcggcgucuucacguccguggggaagcuggugcaccagaucuucggcaccgccuacgggguccucuucagcggcguguccuggaccaugaagaucgggaucggcgugcugcugaccuggcucggccugaacagccgcuccacgagccuguccaugaccugcaucgccgucgggcucgugacccuguaccugggcgugaugguccaggccgacagcgggugcgugaucaacuggaagggccgggagcucaagugcgggagcggcaucuucgugaccaacgagguccacacguggaccgagcaguacaaguuccaggccgacuccccgaagcgccugagcgcggccaucggcaaggccugggaggagggggugugcggcauccgguccgccacccgccuggagaacaucauguggcggcagaucagcaacgagcucaaccacauccugcuggagaacgacaugaaguucaccguggucgugggggacguggucggcauccucgcccaggggaagaagaugauccgcccccagcccauggagcacaaguacuccuggaaguccuggggcaaggcgaagaucaucggcgccgacgugcagaacaccacguucaucaucgacgggcccaacaccccggagugccccgacgaccagcgggccuggaacaucugggagguggaggacuacggcuucgggaucuucaccaccaacaucuggcugaagcugcgcgacuccuacacgcaggucugcgaccaccggcucaugagcgccgcgaucaaggacuccaaggccgugcacgccgacaugggcuacuggaucgagagcgagaagaacgagaccuggaagcuggcccgcgccuccuucaucgaggugaagaccugcaucuggcccaagagccacacccugugguccaacggcguccucgagagcgagaugaucauccccaagaucuacgggggcccgaucucccagcacaacuaccggcccggguacuucacgcagaccgcgggccccuggcaccuggggaagcuggagcucgacuucgaccugugcgagggcaccaccgugguggucgacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgugaaggagaaggaggagaaccuggucaagagcauggugagcgccggcuccggcgagguggacagcuucucccucgggcugcugugcaucagcaucaugaucgaggaggucaugcggucccgcuggagccggaagaugcucaugaccggcacccuggccguguucuuccugcucaucguggggcagcugaccuggaacgaccugauccgccucugcaucauggucggcgccaacgccuccgaccgcauggggaugggcacgaccuaccuggcgcugauggccaccuucaagaugcggccgauguucgccguggggcuccuguuccgccggcugaccagccgcgagguccuccugcugacgaucgggcucucccugguggccagcguggagcugcccaacucccucgaggagcugggcgacgggcuggccaugggcaucaugauccucaagcugcugaccgacuuccagagcuaccagcucugggcgacccugcugucccucaccuucaucaagacgaccuucagccugcacuacgccuggaagaccauggccaugguccuguccaucgugagccuccugccccugugccucuccaccacgagccagaagaccaccuggcugcccgugcugcucggcucccuggggugcaagccgcugaccauguucuucaucgccgagaacaagaucuggggccgcaagagcuggccccucaacgaggggaucauggcggucggcaucgugagcauccugcuguccagccuccugaagaacgacgugccccuggccgggccccucaucgccggcggcaugcugaucgccugcuacgucaucuccgggagcuccgccgaccugagccucgagaaggcggccgagguguccugggaggaggaggccgagcacagcggcgccucccacaacauccugguggagguccaggacgacgggacgaugaagaucaaggacgaggagcgcgacgacacccugaccauccuccugaaggccacccugcucgcggugagcggcguguacccgcuguccauccccgccacccuguucgucugguacuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgccguccucauguaccaggggaagcggcuggagcccuccugggccagcgugaagaaggaccugaucuccuacggcggcggguggcgccuccagggcagcuggaacaccggggaggaggugcaggucaucgcgguggagcccggcaagaaccccaagaacgugcagacggcccccgggaccuucaagacccccgagggcgaggucggcgccaucgcccuggacuucaagcccgggaccuccggcagccccaucgugaaccgggaggggaagaucgugggccuguacggcaacggggucgugacgaccagcggcaccuacguguccgccaucgcgcaggccaaggccagccaggaggggccgcuccccgagaucgaggacgaggucuuccgcaagcggaaccugaccaucauggaccugcaccccggcuccgggaagacgcgccgguaccucccggccaucgugcgcgaggcgaucaagcggaagcugcgcacccugauccucgcccccacccgcguggucgccagcgagauggccgaggcccugaagggcaugcccauccgguaccagaccacggcggugaaguccgagcacaccggccgcgagaucguggaccugaugugccacgccaccuucaccaugcggcuccugagccccguccgcgugccgaacuacaacaugaucaucauggacgaggcccacuucacggaccccuccagcaucgccgcccggggguacaucuccacccgcgugggcaugggggaggcggccgccaucuucaugaccgccacgccgcccggcagcgucgaggccuucccgcaguccaacgcggugauccaggacgaggagcgggacauccccgagcgcagcuggaacuccggguacgaguggaucacggacuuccccggcaagaccgugugguucguccccagcaucaaguccggcaacgacaucgccaacugccugcggaagaacgggaagcgcgugauccagcucagccggaagaccuucgacaccgaguaccagaagacgaagaacaacgacugggacuacguggucaccaccgacaucuccgagaugggcgccaacuuccgcgccgaccgggugaucgacccgcgccggugccugaagcccgucauccugaaggacgggcccgagcgcgugauccucgcgggccccaugccggugaccgucgccagcgccgcccagcggcgcgggcggaucggccgcaaccacaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgcgagaaguccgccgccaucgacggggaguaccggcugcgcggcgaggcccggaagaccuucguggagcucaugcgccgcggggaccugcccguguggcugagcuacaaggucgcgagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcacguacagcgacccccucgcccugcgggaguucaaggaguucgccgccggccgccgguccaucagcggggaccugauccucgagaucggcaagcugccgcagcaccugacccagcgcgcgcagaacgcccucgacaaccuggucaugcugcacaacuccgagcagggcgggcgggccuaccgccacgccauggaggagcuccccgacaccaucgagacccugaugcugcucgcgcugaucgccgugcugacgggcggggugacccucuucuuccugagcggccgggggcugggcaagaccuccaucggccuccugugcgucauggccagcuccgcccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagacgaccaagaaggaccuggggaucggccacgucgcgguggagaaccaccaccacgccaccaugcucgacguggaccugcaccccgccagcgccuggacccuguacgccgucgcgacgaccaucaucaccccgaugaugcgccacaccaucgagaacacgaccgccaacaucucccucaccgccaucgccaaccaggccgcgauccugauggggcuggacaagggcuggcccaucagcaagauggacaucggcgugccccuccuggcccuggggugcuacucccaggugaacccccucacccugacggccgccguccugaugcucguggcgcacuacgccaucaucggcccggggcugcaggccaaggccacccgcgaggcccagaagcggaccgcggccggcaucaugaagaaccccaccguggacgggaucgucgccaucgaccuggaccccgugguguacgacgccaaguucgagaagcagcucggccagaucaugcugcugauccucugcacgagccagauccugcugaugcgcaccaccugggcccucugcgaguccaucacccuggcgacgggcccccugaccacccucugggaggggagcccgggcaaguucuggaacaccacgaucgccgucuccauggccaacaucuuccgggggagcuaccuggccggcgccggccuggcguucagccucaugaagucccucgggggcgggcgccgggggaccggggcccagggcgagacccugggcgagaaguggaagcgccagcucaaccagcugagcaaguccgaguucaacaccuacaagcggagcgggauccuggagguggaccgcuccgaggccaaggagggccuccggcgcggggagacgaccaagcacgccgugagccggggcaccgcgaagcugcgcugguucgucgagcggaaccuggugaagcccgaggggaaggugaucgaccugggcugcggccgcgggggcugguccuacuacugcgccgggcucaagaaggucaccgaggugaagggcuacacgaagggcgggcccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccggacgcugcgcgugcucaagaugguggagcccuggcugcgggggaaccaguucugcaucaagauccugaaccccuacaugcccuccgucguggagacccucgagcagaugcagcgcaagcacggcggcaugcuggugcggaacccgcugagccgcaacuccacccacgagauguacugggucagcugcgggaccggcaacaucguguccgccgugaacaugaccagccgcaugcuccugaaccgguucacgauggcccaccgcaagcccaccuacgagcgggacgucgaccugggggcgggcacccgccacguggccguggagcccgaggucgccaaccucgacaucaucggccagcggaucgagaacaucaagcacgagcacaaguccaccuggcacuacgacgaggacaaccccuacaagacgugggccuaccacgggagcuacgaggugaagccguccggcagcgccagcuccauggucaacgggguggugaagcugcugaccaagcccugggacgucauccccauggugacccagaucgcgaugaccgacacgacccccuucggccagcagcgcguguucaaggagaaggucgacacccggaccccgaaggccaagcgcgggacggcccagaucauggaggugaccgcccgguggcucuggggcuuccugagccgcaacaagaagccccggaucugcacccgcgaggaguucacccggaaggugcgcuccaacgccgcgaucggcgccgucuucguggacgagaaccaguggaacagcgccaaggaggccguggaggacgagcgguucugggaccugguccaccgcgagcgggagcuccacaagcaggggaagugcgcgacgugcguguacaacaugaugggcaagcgcgagaagaagcugggggaguucggcaaggccaaggggucccgggccaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagauccccgggggcaacauguacgcggacgacaccgccggcugggacacccgcaucaccgaggacgaccuccagaacgaggccaagaucacggacaucauggagccggagcacgcccugcuggccaccagcaucuucaagcucaccuaccagaacaaggucgugcgggugcagcgccccgcgaagaacgggaccgucauggacgugaucucccggcgcgaccagcggggcagcggccaggugggcacguacggccugaacaccuucaccaacauggaggcccagcugauccgccagauggaguccgaggggaucuucagccccuccgagcucgagacccccaaccuggccgagcggguccuggacuggcucgagaaguacggcguggagcgccugaagcggauggccaucagcggggacgacugcguggucaagccgaucgacgaccgcuucgccacggcgcugaccgcccucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucagccagggggccggcuggucccuccgcgagaccgccugccugggcaagagcuacgcgcagauguggcagcugauguacuuccaccggcgcgaccuccggcuggccgccaacgccaucugcuccgcggugcccguggacuggguccccaccagccgcacgaccugguccauccacgcccaccaccaguggaugaccaccgaggacaugcugagcguguggaaccgcguguggaucgaggagaaccccuggauggaggacaagacgcacaucuccagcugggaggacgucccguaccucggcaagcgggaggaccaguggugcgggucccugaucggccugaccgcccgcgccaccugggccaccaacauccagguggcgaucaaccaggugcggcgccucaucggcaacgagaacuaccuggacuucaugaccagcaugaagcgguucaagaacgaguccgacacggagggggcccugugguga

SEQ ID NO: 8016 - RNA, 9879 nt, Artificial Sequence
  derived and/or modified CDS sequence (opt1) from DENV-1__FJ639677__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcgugaccgaggccgagcccgacgacguggacugcuggugcaacgccaccgacacgugggugaccuacgggaccugcagccagaccggcgagcaccggcgcgacaagcgguccguggcccucgcgccccacgucggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcggugcugcggaagcucugcaucgaggccaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucgugcacaagcagugguuccuggaccugccccuccccuggaccagcggggccagcaccucccaggagacguggaaccggcaggaccugcuggucaccuucaagaccgcccacgcgaagaagcaggagguggugguccucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcgucuucaccagcguggggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccgucgggcucgugacccuguaccugggcgugaugguccaggccgacuccgggugcgugaucaacuggaagggccgggagcucaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaagcucaccguggucgugggggacguggcgggcauccuggcccaggggaagaagaugauccggccccagcccauggaguacaaguacagcuggaaguccuggggcaaggccaagaucaucggcgccgacgcgcagaacacgaccuucaucaucgacgggcccaacaccccggagugccccgacgaccagcgcgccuggaacaucugggaggucgaggacuacggcuucgggaucuucaccacgaacaucuggcugaagcuccgggacagcuacacccaggugugcgaccaccgccugauguccgccgccaucaaggacagcaaggccgugcacgcggacaugggcuacuggaucgaguccgagaagaacgagaccuggaagcuggcccgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggcgguguucuuccuccugaucauggggcagcugacguggaacgaccucauccgccugugcaucauggucggcgccaacgccagcgaccgcauggggaugggcaccaccuaccuggcccucauggccaccuucaagaugcggccgauguucgcgaugggccugcuguuccgccggcucacgucccgcgaggugcugcugcucaccaucgggcugagccugguggccuccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgcguggaagaccauggccauggugcucagcaucgucucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggaccaugaagaucaaggacgaggagcgcgacgacacccucaccauccugcugaaggccacccuccuggccgucuccggcguguacccgcugagcauccccgccacccuguucgugugguacuucuggcagaagaagaagcagcgguccgggguccugugggacacccccagcccgcccgagguggagcgcgcggugcuggacgacggcaucuaccggaucaugcagcgcggccugcucgggcggucccaggucggcguggggguguuccaggagaacgucuuccacaccauguggcacgugacccgcggcgccgugcugauguaccaggggaagcggcuggagcccagcugggccuccgucaagaaggaccucaucagcuacggcggcggguggcgccugaagggcuccuggaacacgggggaggagguccaggugaucgccgucgagcccggcaagaaccccaagaacgugcagaccgcccccgggaccuucaagacccccgagggcgaggugggcgcgaucgcccuggacuucaagcccgggacgagcggcucccccaucgucaaccgggaggggaagaucgugggccucuacggcaacgggguggucaccaccagcggcaccuacgugagcgccaucgcccaggcgaaggccucccaggaggggccgcugcccgagaucgaggacgagguguuccgcaagcggaaccugacgaucauggaccuccaccccggcagcgggaagacccgccgguaccugccggccaucguccgcgaggccaucaagcggaagcugcgcacccucauccuggcccccacccgcgugguggcguccgagauggccgaggcccugaagggcaugcccauccgguaccagacgaccgccgucaagagcgagcacaccggcaaggagaucguggaccucaugugccacgccaccuucacgaugcgccugcugucccccgugcgggucccgaacuacaacaugaucaucauggacgaggcgcacuucaccgaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccuccgcaagaacgggaagcgggucauccagcugucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccucaaggacgggcccgagcgggugauccuggccggccccaugccggucacgguggccuccgcggcccagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgcggccaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggacgaaggagggggagcgcaagaagcugcggccccgcuggcucgacgcccggaccuacuccgacccccuggcgcugcgcgaguucaaggaguucgccgccggccggcgcagcguguccggggaccucauccuggagaucggcaagcugccgcagcaccucacccagcgggcccagaacgcgcuggacaaccuggucaugcuccacaacagcgagcagggcgggcgcgccuaccggcacgccauggaggagcugcccgacaccaucgagacgcugaugcuccuggcccugaucgccgugcucaccggcggggugacccuguucuuccuguccggccgcgggcucggcaagaccagcaucggccugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucgggcugcuguucaugauccucacggucgcggccaacgagaugggccugcuggagaccaccaagaaggaccucgggaucggccacguggccguggagaaccaccaccacgccgccaugcuggacgucgaccugcaccccgcguccgccuggacccucuacgccguggccacgaccaucaucaccccgaugaugcggcacaccaucgagaacacgaccgccaacaucagccugaccgcgaucgccaaccaggccgccauccugauggggcucgacaagggcuggcccaucuccaagauggacaucggcgugccccugcuggcgcucgggugcuacagccaggucaacccccugacccugacggccgccgugcucaugcugguggcccacuacgccaucaucggcccggggcugcaggcgaaggccacccgcgaggcccagaagcgcaccgccgccggcaucaugaagaaccccaccgucgacgggaucguggcgaucgaccucgaccccguggucuacgacgccaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggcgaacaucuuccgcggguccuaccuggccggcgccggccucgccuucagccugaugaagucccucgggggcgggcggcgcgggaccggggcgcagggcgagacccucggcgagaaguggaagcggcagcugaaccagcuguccaagagcgaguucaacaccuacaagcgcuccgggaucauggagguggaccggagcgaggccaaggagggccucaagcgcggggagacgaccaagcacgccgucucccggggcaccgccaagcugcgcugguucguggagcggaaccuggugaagcccgaggggaaggucaucgaccugggcugcggccgcgggggcuggagcuacuacugcgccgggcucaagaaggugaccgaggugaagggcuacacgaagggcggccccggccacgaggagcccaucccgauggcgaccuacggguggaaccuggucaagcugcacuccggcaaggacguguucuucaucccgcccgagaagugcgacacccuccugugcgacaucggggagagcucccccaacccgaccaucgaggagggccggacgcugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggaccggcaacaucgugagcgccgucaacaugaccucccggaugcuccugaaccgcuucacgauggcccaccgcaagcccaccuacgagcgggacguggaccuggggaccggcacccgccacguggccgucgagcccgagguggccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcugcugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgcgguggcucuggggcuuccugucccgcagcaagaagccccggaucugcacccgcgaggaguucauccggaagguccgcuccaacgccgccaucggcgccguguucguggacgagaaccaguggaacagcgcgaaggaggccgucgaggacgagcgguucugggaccuggugcaccgcgagcgggagcuccacaagcaggggaagugcgccacgugcguguacaacaugaugggcaagcgcgagaagaagcugggggaguucggcaaggccaaggggucccgggccaucugguacauguggcugggcgcgcgcuuccucgaguucgaggcccugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucaccgaggacgaccuccagaacgaggccaagaucacggacaucauggagccggagcacgcgcugcuggccaaggccaucuucaagcucaccuaccagaacaagguggugcgcguccagcgccccgccaagaacgggaccgugauggacgugaucagccggcgcgaccagcggggcuccgggcaggucggcaccuacggccugaacacguucaccaacauggaggcccagcugauccgccagauggagagcgaggggaucuucucccccagcgagcucgagacccccaaccuggcggagcgggcccuggacuggcucgagaaguacggcguggagcgccugaagcggauggccaucuccggggacgacugcguggucaagccgaucgacgaccgcuucgccaccgcccugacggcgcucaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcuggugggccgcgcccgggucagccagggggccggcuggagccuccgcgagaccgccugccuggggaaguccuacgcgcagauguggcagcugauguacuuccaccggcgcgaccuccggcuggccgccaacgccaucugcagcgccgugcccguggacuggguccccaccucccgcaccacguggagcauccacgcgcaccaccaguggaugaccaccgaggacaugcuguccguguggaaccggguguggaucgaggagaaccccuggauggaggacaagacccacaucagcuccugggaggacgucccguaccucggcaagcgcgaggaccaguggugcgggagccugaucggccugacggcccgcgccaccugggccaccaacauccagguggccaucaaccaggugcggcgccucaucggcaacgagaacuaccuggacuacaugaccuccaugaagcgguucaagaacgagagcgaccccgagggggcgcugugguga

SEQ ID NO: 8017 - RNA, 9879 nt, Artificial Sequence
  derived and/or modified CDS sequence (opt1) from DENV-1__GQ868618__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggaggggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucaccauggcccaccgcaagccgacguacgagcgcgacguggaccucggggccggcacccggcacgucgccguggagcccgagguggccaaccuggacaucaucggccagcgcaucgagaacaucaagcacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggccgagcgggugcucgacuggcuggagaagcacggcgucgagcgccugaagcggauggcgaucuccggggacgacugcguggugaagcccaucgacgaccgcuucgccaccgcccucaccgcccugaacgacaugggcaagguccggaaggacaucccgcagugggagcccagcaagggguggaacgacuggcagcagguccccuucugcagccaccacuuccaccagcugaucaugaaggacggccgcgagaucgugguccccugccggaaccaggacgagcucgugggccgcgcccgggugucccagggggcgggcuggagccugcgcgagacggccugccuggggaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccuggggcgacgugcccuaccuggggaagcgcgaggaccaguggugcggcagccugaucggccucaccgcccgggcgacgugggccaccaacauccaggucgccaucaaccaggugcgccgccugaucgggaacgagaacuaccuggacuacaugaccuccaugaagcgguucaagaacgagagcgacccggagggcgcccucugguga

SEQ ID NO: 8018 - RNA, 9879 nt, Artificial Sequence
  derived and/or modified CDS sequence (opt1) from DENV-1__GQ868619__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggcccaggggaagaagaugauccggccccagcccauggaguacaaguacagcuggaaguccuggggcaaggccaagaucaucggcgccgacgcgcagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggugguguucuuccuccugaucauggggcagcugacguggaacgaccucauccgccugugcaucauggucggcgcgaacgccagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgcguccguggagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgucggcaucgugagcauccugcucagcucccugcugaagaacgacgugccccucgccgggccccugaucgccggcggcaugcugaucgcgugcuacgucaucagcggguccagcgccgaccucucccuggagaaggccgccgaggugagcugggaggaggaggccgagcacuccggcgcgagccacaacauccugguggagguccaggacgacgggaccaugaagaucaaggacgaggagcgcgacgacacccucaccauccugcugaaggccacccuccuggccguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacccgcggcgcgguccugauguaccaggggaagcggcuggagcccagcugggccuccgugaagaaggaccucaucagcuacggcggcggguggcgccugcagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccucuacggcaacggggucgugaccaccagcggcaccuacgugagcgccaucgcccaggccaaggcgucccaggaggggccgcugcccgagaucgaggacgaggucuuccgcaagcggaaccugacgaucauggaccuccaccccggcagcgggaagacccgccgguaccugccggccaucgugcgcgaggccaucaagcggaagcugcgcacccucauccuggcccccacccgcguggucgccuccgagauggcggaggcccugaagggcaugcccauccgguaccagacgaccgccgucaagagcgagcacaccggcaaggagaucguggaccucaugugccacgccaccuucacgaugcgccugcugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccauggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccuccgcaagaacgggaagcgggucauccagcugucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccaucauccucaaggacgggcccgagcgggugauccuggccggccccaugccggugacggucgccuccgccgcgcagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgcggccggccggcgcagcguguccggggaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccguccucaccggcggggugaugcuguucuuccuguccggccgcgggcucggcaagaccagcaucggccugcugugcgugauggccuccagcgggcuccuguggauggcguccgucgagccccacuggaucgccgccagcaucauccuggaguucuuccucauggugcugcugauccccgagccggaccggcagcgcacgccccaggacaaccagcucgccuacguggucaugggccugcuguucaugauccucaccguggccgcgaacgagauggggcugcuggagacgaccaagaaggaccucggcaucgggcacguggccgucgagaaccaccaccacgccgccaugcuggacguggaccugcaccccgccuccgcguggacccucuacgccguggccaccacgaucaucaccccgaugaugcggcacaccaucgagaacaccacggccaacaucagccugaccgccaucgcgaaccaggccgccauccugaugggccucgacaagggcuggcccaucuccaagauggacaucggggucccccugcuggcccucggcugcuacagccaggugaacccccugacccugaccgcggccgugcucaugcuggucgcccacuacgccaucaucgggccgggccugcaggccaaggcgacgcgcgaggcccagaagcgcaccgccgccgggaucaugaagaaccccaccguggacggcaucguggccaucgaccucgaccccgucguguacgacgcgaaguucgagaagcagcugggccagaucaugcugcucauccugugcaccucccagauccugcucaugcggacgaccugggcccugugcgagagcaucacccuggccaccgggccccucacgacccugugggagggcuccccggggaaguucuggaacaccaccaucgccgugagcauggccaacaucuuccgcggcuccuaccuggcgggcgccgggcucgccuucagccugaugaagucccugggcgggggccggcgcgggacgggcgcccagggcgagacccucggggagaaguggaagcggcagcugaaccagcuguccaagagcgaguucaacaccuacaagcgcuccggcaucauggaggucgaccggagcgaggcgaaggaggggcucaagcgcggcgagaccacgaagcacgccgugucccgggggaccgccaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccacguacggcuggaaccuggugaagcugcacuccgggaaggacguguucuucaucccgcccgagaagugcgacacccuccugugcgacaucggcgagagcucccccaacccgaccaucgaggaggggcggacccugcgcguccucaagaugguggagcccuggcugcggggcaaccaguucugcaucaagauccugaaccccuacaugcccagcguggucgagacgcucgagcagaugcagcgcaagcacggcgggaugcuggugcggaacccgcugucccgcaacagcacccacgagauguacuggguguccugcggcaccgggaacaucgucagcgcggugaacaugaccucccggaugcuccugaaccgcuucaccauggcccaccgcaagcccacguacgagcgggacguggaccugggcaccggcacccgccacgucgccguggagcccgagguggccaaccucgacaucaucgggcagcggaucgagaacaucaagcacgagcacaagagcaccuggcacuacgacgaggacaaccccuacaagacgugggccuaccacggcuccuacgaggucaagccgagcggguccgcgagcagcauggugaacggcguggucaagcugcugaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcccgguggcucuggggcuuccugucccgcaacaagaagccccggaucugcacccgcgaggaguucacccggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgccacgugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccggaucaccgaggacgaccuccagaacgaggccaagaucacggacaucauggagccggagcacgcccugcuggcgaaggccaucuucaagcucaccuaccagaacaaggugguccgcgugcagcgccccgccaagaacggcaccgugauggacgucaucucccggcgcgaccagcgggggagcggccaggugggcaccuacgggcugaacacguucaccaacauggaggcccagcugauccgccagauggaguccgagggcaucuucagccccuccgagcucgagacccccaaccuggccgagcgggcgcuggacuggcucgagaaguacgggguggagcgccugaagcggauggccaucagcggcgacgacugcgucgugaagccgaucgacgaccgcuucgccaccgcccugacggcccucaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcuggucgggcgcgcgcgggugucccagggcgccggguggagccuccgcgagaccgccugccugggcaagagcuacgcccagauguggcagcugauguacuuccaccggcgcgaccuccggcuggcggccaacgccaucugcuccgccgugcccgucgacugggugcccaccagccgcaccacgugguccauccacgcccaccaccaguggaugaccaccgaggacaugcugagcguguggaaccgggucuggaucgaggagaaccccuggauggaggacaagacccacaucuccagcugggaggacgugccguaccucgggaagcgcgaggaccaguggugcggcucccugaucggccugacggcgcgcgccaccugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8019 - RNA, 9879 nt, Artificial Sequence
  derived and/or modified CDS sequence (opt1) from DENV-1__FJ639678__SS-prME
agcgugaccaugcugcucaugcugaugcccaccgcccuggccuuccaccucaccacccggggcggggagccgcacaugaucgugagcaagcaggagcgggggaaggcgcugcuguucaagaccagcgccggggugaacaugugcacccucaucgccauggaccugggcgagcugugcgaggacaccaugaccuacaagugcccccggaucaccgagguggagcccgacgacgucgacugcuggugcaacgccaccgacaccugggugaccuacgggaccugcccccagaccggcgagcaccggcgcgaccggcgcuccguggcccucgcgccccacgucggccuggggcuggagacccgggccgagaccuggaugagcuccgagggcgccuggaagcagauccagcgcguggagaccugggcccuccggcaccccggguucaccgugaucgcgcuguuccuggcccacgccaucggcacgagcaucacccagaaggggaucaucuucauccuccugaugcuggucacccccuccauggccaugcgcugcgugggcaucggcaaccgggacuucguggaggggcucagcggcgccaccugggucgacguggugcuggagcacggguccugcgucacgaccauggcgaaggacaagcccacccuggacaucgagcuccugaagaccgaggugacgaacccggccgugcugcgcaagcucugcaucgaggccaagaucagcaacaccaccaccgacucccggugccccacgcagggcgaggccacccuggucgaggagcaggacgccaacuucgugugccgccggaccuucguggaccgcggcugggggaacggcugcgggcuguucggcaaggggagccucaucacgugcgcgaaguucaagugcgucacgaagcuggagggcaagaucgugcaguacgagaaccugaaguacuccgugaucgucaccgugcacaccggcgaccagcaccaggucgggaacgagagcaccgagcacggcacgaccgccaccaucacgccccaggcccccaccuccgagauccagcucacggacuacggggcccugacccuggacugcagcccgcggaccggccucgacuucaacgagauggugcugcugaccaugaaggagaaguccuggcucgugcacaagcagugguuccuggaccugccccuccccuggacgagcggggccuccaccagccaggagaccuggaaccgccaggaccugcuggucaccuucaagacggcgcacgccaagaagcaggagguggugguccucggcagccaggagggcgccaugcacaccgcccugaccggggccaccgagauccagacguccggcaccaccaccaucuucgcggggcaccugaagugccggcucaagauggacaagcugacgcugaagggcaugagcuacgugaugugcaccggguccuucaagcucgagaaggagguggccgagacccagcacggcaccguccuggugcagaucaaguacgagggcacggacgcccccugcaagaucccguucagcacccaggacgagaagggggugacccagaacggccgccugaucaccgccaaccccaucgucacggacaaggagaagcccgugaacaucgaggcggagcccccguucggggaguccuacaucgugaucggcgccggcgagaaggcccugaagcucagcugguucaagaagggguccagcaucggcaagauguucgaggccaccgcccgcggggcccgccgcauggccauccugggcgacaccgccugggacuucggguccaucggcggcgucuucaccagcguggggaagcuggugcaccagaucuucggcacggccuacgggguccucuucuccggcgugagcuggaccaugaagaucgggaucggcgugcugcugaccuggcucggccugaacucccggagcaccucccugagcaugacgugcaucgccgucgggcucgugacccuguaccugggcgugaugguccaggcggacuccgggugcgugaucaacuggaagggccgcgagcucaagugcgggagcggcaucuucgugaccaacgagguccacaccuggacggagcaguacaaguuccaggccgacucccccaagcggcugagcgccgccaucggcaaggccugggaggagggggugugcggcauccgcagcgcgacccggcuggagaacaucauguggaagcagaucuccaacgagcucaaccacauccugcuggagaacgacaugaaguucaccguggucgugggggacguggucggcauccucgcccaggggaagaagaugauccgcccccagcccauggaguacaaguacagcuggaaguccuggggcaaggccaagaucaucggcgccgacauccagaacaccaccuucaucaucgacgggccgaacacgcccgagugccccgacgaccagcgggcguggaacaucugggagguggaggacuacggcuucgggaucuucaccaccaacaucuggcugaagcugcgcgacagcuacacccaggugugcgaccaccggcucauguccgccgccaucaaggacagcaaggccguccacgccgacaugggcuacuggaucgaguccgagaagaacgagacguggaagcuggcgcgcgccagcuucaucgaggugaagaccugcaucuggcccaagucccacacccuguggagcaacggcgugcucgaguccgagaugaucaucccgaagaucuacgggggccccaucagccagcacaacuaccggcccggguacuucacccagacggccggcccguggcaccuggggaagcuggagcucgacuucgaccugugcgagggcaccaccgucgugguggacgagcacugcggcaaccgcgggcccucccugcggaccacgaccgucaccggcaagaucauccacgaguggugcugccgcagcugcacccugccgccccuccgguucaagggggaggacggcugcugguacgggauggagauccgcccggugaaggagaaggaggagaaccuggugaaguccauggucagcgccggcuccggcgagguggacagcuucagccucgggcugcugugcaucuccaucaugaucgaggaggugaugcggagccgcuggucccggaagaugcucaugacgggcacccuggccgucuucuuccugcucaucauggggcagcugaccuggaacgaccugauccgccucugcaucauggugggcgcgaacgccagcgaccgcauggggaugggcaccacguaccuggcccugauggccaccuucaagaugcggcccauguucgccgugggccuccuguuccgccggcugaccucccgcgagguccuccugcugaccaucgggcucagccugguggcguccgucgagcugcccaacagccucgaggagcugggcgacgggcuggccaugggcaucaugauccucaagcugcugacggacuuccagucccaccagcucugggccacccugcugagccucaccuucaucaagaccacguucucccugcacuacgccuggaagaccauggcgauggugcugagcaucgugucccuccugccccugugccucagcaccaccucccagaagacgaccuggcugccgguccugcucggcagccuggggugcaagccccugaccauguuccucaucgccgagaacaagaucuggggccggaaguccuggccccugaacgaggggaucauggccgugggcaucgugagcauccugcucuccagccugcugaagaacgacgucccccucgccgggccgcugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgcgacgacacgcucaccauccugcugaaggccacccuccuggccguguccggcgucuacccccugagcauccccgccacccucuuccugugguacuucuggcagaagaagaagcagcgguccggggugcugugggacacccccagcccgcccgagguggagcgcgccguccuggacgacggcaucuaccggaucaugcagcgcggccuccuggggcggucccaggugggcgugggggucuuccaggagaacguguuccacacgauguggcacgugacccgcggcgcgguccugauguaccaggggaagcggcucgagcccagcugggccuccgugaagaaggaccugaucagcuacggcggcggguggcgccugcagggcuccuggaacaccggggaggaggugcaggucaucgccguggagcccggcaagaacccgaagaacgugcagaccgcccccgggacguucaagacccccgagggcgaggucggcgccaucgcgcucgacuucaagcccgggaccagcggcuccccgaucgugaaccgggaggggaagaucgugggccuguacggcaacggggucgugaccacgagcggcaccuacguguccgccaucgcccaggccaaggcgagccaggaggggccccugcccgagaucgaggacgaggucuuccgcaagcggaaccucaccaucauggaccugcacccgggcagcgggaagacccgccgguaccugcccgccaucgugcgcgaggccaucaagcggaagcuccgcacgcugauccuggcccccacccgcguggucgccuccgagauggcggaggcccucaagggcaugcccauccgguaccagaccaccgccgucaagagcgagcacacgggcaaggagaucguggaccugaugugccacgccaccuucaccaugcgccugcucuccccgguccgggugcccaacuacaacaugaucaucauggacgaggcccacuucaccgaccccagcuccaucgcggcccgcggguacaucagcacgcgggugggcaugggggaggccgccgccaucuucaugaccgcgacgccgcccggcuccgucgaggccuucccccagagcaacgccgugauccaggacgaggagcgcgacauccccgagcgguccuggaacagcggguacgaguggaucaccgacuuccccggcaagacggugugguucguccccuccaucaagagcggcaacgacaucgccaacugccugcgcaagaacgggaagcgggugauccagcugucccgcaagaccuucgacaccgaguaccagaagaccaagaacaacgacugggacuacguggucacgaccgacaucagcgagaugggcgcgaacuuccgggccgaccgcgugaucgacccccggcgcugccucaagcccgugauccugaaggacgggcaggagcgggucauccuggccggccccaugccggugaccgucgccuccgccgcgcagcgccgggggcgcaucggccggaaccacaacaaggagggcgaccaguacaucuacauggggcagccccucaacaacgacgaggaccacgcccacuggaccgaggccaagaugcugcuggacaacaucaacacgcccgagggcaucauccccgcccucuucgagccggagcgcgagaaguccgccgcgaucgacggggaguaccgccugcggggcgaggcccgcaagaccuucguggagcugaugcggcgcggggaccuccccguguggcuguccuacaaggucgccagcgagggcuuccaguacuccgaccggcgcuggugcuucgacggcgagcggaacaaccaggugcuggaggagaacauggacguggagaucuggaccaaggagggggagcgcaagaagcuccggccccgcuggcuggacgcccggaccuacagcgacccccuggcccuccgcgaguucaaggaguucgcggccggccggcgcagcgucuccggggaccugauccuggagaucggcaagcucccgcagcaccugacgcagaaggcccagaacgcccuggacaaccucgugaugcugcacaacagcgagcagggcgggcgggcguaccgccacgccauggaggagcugcccgacaccaucgagacccucaugcugcuggcccucaucgccgugcugaccggcggggucacgcuguucuuccucuccggccgggggcugggcaagaccagcaucggccugcucugcgugauggccuccagcgcgcugcuguggauggccuccguggagccccacuggaucgccgccagcaucauccucgaguucuuccugaugguccugcucauccccgagccggaccgccagcggacgccccaggacaaccagcuggccuacguggugaucgggcuccuguucaugauccugaccgucgcggccaacgagaugggccugcucgagaccacgaagaaggaccuggggaucggccacguggccguggagaaccaccaccacgccaccaugcuggacgucgaccuccaccccgccuccgcguggacccuguacgccguggccaccacgaucaucaccccgaugaugcgccacaccaucgagaacaccacggccaacaucagccugaccgccaucgcgaaccaggccgccauccucauggggcuggacaagggcuggcccaucuccaagauggacaucggcgugccccugcucgcccuggggugcuacagccaggucaacccccugacccucaccgcggccgugcugaugcugguggcccacuacgccaucaucggcccggggcuccaggccaaggcgacgcgggaggcccagaagcgcaccgccgccggcaucaugaagaaccccaccgucgacgggaucguggccaucgaccuggaccccguggucuacgacgcgaaguucgagaagcagcugggccagaucaugcuccugauccugugcaccucccagauccuccugaugcgcacgaccugggcccugugcgagagcaucacccucgccaccggcccccugacgacccugugggagggguccccgggcaaguucuggaacaccaccaucgccgugagcauggccaacaucuuccggggguccuaccucgcgggcgccggccuggccuucagccugaugaagucccucgggggcgggcgccggggcacgggggcccagggcgagacccugggcgagaaguggaagcgccagcugaaccagcucagcaagagcgaguucaacaccuacaagcgguccgggaucauggagguggaccgcagcgaggcgaaggagggccugaagcgcggggagaccacgcgccacgccgucucccggggcaccgccaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagcccaucccgauggccacguacggguggaaccuggucaagcuccacuccggcaaggacguguucuucaucccgcccgagaagugcgacacccugcugugcgacaucggggagagcucccccaacccgaccaucgaggagggccggacccuccgcgugcugaagauggucgagcccuggcugcgggggaaccaguucugcaucaagauccucaaccccuacaugcccagcgugguggagacgcuggagcagaugcagcgcaagcacggcggcaugcugguccggaacccgcucucccgcaacagcacccacgagauguacuggguguccugcgggaccggcaacaucgugagcgcggucaacaugaccucccggaugcugcugaaccgcuucaccauggcccaccgcaagcccacguacgagcgggacguggaccucggggccggcacccgccacguggccgucgagcccgagguggccaaccuggacaucaucggccagcggaucgagaacaucaagcacgagcacaagagcaccuggcacuacgacgaggacaaccccuacaagaccugggcguaccacggguccuacgaggugaagccgagcggcuccgccagcuccauggucaacgggguggucaagcugcucacgaagcccugggacgugauccccauggugacccagaucgccaugaccgacaccacgcccuucggccagcagcgcgucuucaaggagaagguggacacccggaccccgaaggccaagcaggggaccgcccagaucauggaggugacggcgcgcuggcuguggggcuuccugagccggaacaagaagccccgcaucugcacccgggaggaguucacccgcaagguccggagcaacgccgccaucggcgccguguucguggacgagaaccaguggaacuccgcgaaggaggccgucgaggacgagcgcuucugggaccucgugcaccgggagcgcgagcugcacaagcaggggaagugcgcgaccugcguguacaacaugaugggcaagcgggagaagaagcugggggaguucggcaaggccaaggggagccgcgccaucugguacauguggcucggcgcgcgguuccuggaguucgaggcccugggcuucaugaacgaggaccacugguucucccgcgagaacagccucuccggggucgagggcgaggggcugcacaagcugggcuacauccuccgggacaucagcaagauccccgggggcaacauguacgccgacgacacggccggcugggacacccgcaucaccgaggacgaccugcggaacgaggccaagaucaccgacaucauggagccggagcacgcgcugcucgccacguccaucuucaagcugaccuaccagaacaagguggugcgcguccagcgccccgccaagaacgggaccgugauggacgugaucagccggcgcgaccagcggggcuccgggcaggucggcaccuacggccugaacacguucaccaacauggaggcccagcucauccgccagauggagagcgaggggaucuucucccccagcgagcuggagacccccaaccuggccgagcgggugcucgacuggcuggagaaguacggcguggagcgccugaagcggauggcgaucuccggggacgacugcgucgugaagccgaucgacgaccgcuucgccaccgcccucacggcccugaacgacaugggcaaggugcggaaggacaucccccagugggagcccagcaagggguggaacgacuggcagcagguccccuucugcucccaccacuuccaccagcugaucaugaaggacggccgcgagaucguggugccgugccggaaccaggacgagcucgucggccgcgcccgggugagccagggggcgggcuggucccugcgcgagaccgccugccugggcaagagcuacgcccagauguggcagcucauguacuuccaccggcgcgaccugcggcuggccgcgaacgccaucugcagcgccgugcccgucgacugggugcccaccucccgcaccacguggagcauccacgcccaccaccaguggaugaccaccgaggacaugcucuccguguggaaccgggucuggaucgaggagaaccccuggauggaggacaagacccacaucagcuccugggaggacgugccguaccugggcaagcgcgaggaccaguggugcgggagccugaucggccucacggcccgcgcgaccugggccaccaacauccagguggccaucaaccagguccggcgccugaucggcaacgagaacuaccuggacuacaugaccuccaugaagcgguucaagaacgagagcgaccccgagggggcccucugguga

SEQ ID NO: 8020 - RNA, 9879 nt, Artificial Sequence
  derived and/or modified CDS sequence (opt1) from DENV-1__FJ639679__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcaccgcgagcgggagcuccacaagcagggcaagugcgccacgugcguguacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacaccgccgggugggacacccggaucaccgaggacgaccuccagaacgaggcccgcaucacggacaucauggagccggagcacgcgcugcuggccaaguccaucuucaagcucaccuaccagaacaagguggugcgcguccagcggcccgccaagaacggcaccgugauggacgugaucagccgccgggaccagcgcggguccggccaggucggcaccuacgggcugaacacguucaccaacauggaggcccagcugauccggcagauggagagcgagggcaucuucucccccagcgagcucgagacccccaaccuggccgcgcgcgugcuggacuggcucgagaaguacgggguggagcggcugaagcgcauggccaucuccggcgacgacugcgucgugaagccgaucgacgaccgguucgccaccgcccugacggcccucaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcuggucgggcgggcgcgcgugagccagggcgccggguggagccuccgggagaccgccugccugggcaaguccuacgcccagauguggcagcugauguacuuccaccgccgggaccuccgccuggcggccaacgccaucugcagcgccgugcccgucgacuggauccccaccucccggaccacguggagcauccacgcccaccaccaguggaugaccaccgaggacaugcuguccguguggaaccgcguguggaucgaggagaaccccuggauggaggacaagacccacaucagcuccuggggcgacgucccguaccucggcaagcgcgaggaccaguggugcggcagccugaucgggcugacggcgcgggccaccugggccaccaacauccagguggccaucaaccaggugcgccggcucaucggcaacgagaacuaccuggacuacaugaccuccaugaagcgcuucaagaacgagagcgaccccgagggggcccugugguga

SEQ ID NO: 8021 - RNA, 9879 nt, Artificial Sequence
  derived and/or modified CDS sequence (opt1) from DENV-1__FJ850069__SS-prME
agcgugaccaugcugcucaugcugaugcccaccgcccuggccuuccaccucaccacccgcggcggggagccccacaugaucgugggcaagcaggagcggggcaagagccugcuguucaagaccagcgccggggugaacaugugcacccucaucgccauggaccugggggagcugugcgaggacacgaugaccuacaagugcccccgcaucaccgagguggagcccgacgacguggacugcuggugcaacaccacggacaccugggugaccuacgggaccugcagccagacgggcgagcaccggcgcgacaagcggagcguggcccucgcgccccacgucgggcugggccuggagacccgcgccgagaccuggauguccagcgagggggcguggaagcagauccagcggguggagaccugggcccuccgccaccccggcuucacggugaucgcccuguuccuggcccacgucaucgggaccuccaucacccagaagggcaucaucuucauccuccugaugcuggugacccccagcauggcgaugcggugcgugggcaucgggucccgcgacuucgucgagggccucagcggggccacguggguggacgugguccuggagcacggcuccugcgugaccaccauggccaaggacaagcccacccuggacaucgagcuccugaagacggaggugaccaaccccgccguccugcggaagcucugcaucgaggccaagaucagcaacaccaccacggacucccgcugcccgacccagggcgaggcgacccugguggaggagcaggacgccaacuucgugugccggcgcaccuucgucgaccggggguggggcaacgggugcggccuguucgggaagggcagccucaucacgugcgccaaguucaagugcgugaccaagcuggagggcaagaucgugcaguacgagaaccugaaguacuccgucaucgugaccguccacaccggggaccagcaccaggugggcaacgagagcacggagcacgggaccaccgccaccaucacgccccaggcccccacguccgagauccagcucaccgacuacggcgcgcugacccuggacugcagcccccgcaccgggcucgacuucaacgagauggugcugcugacgaugaaggagaaguccuggcucguccacaagcagugguuccuggaccugccccuccccuggaccagcggcgccagcaccucccaggagaccuggaaccggcaggaccugcuggugacguucaagaccgcccacgccaagaagcaggagguggucgugcucggcagccaggagggggccaugcacaccgcgcugaccggcgccacggagauccagaccuccgggaccaccacgaucuucgccggccaccugaagugccgccucaagauggacaagcugacccugaaggggaugagcuacgugaugugcaccggcuccuucaagcucgagaaggaggucgccgagacccagcacggcacggugcuggugcagaucaaguacgaggggaccgacgcccccugcaagauccccuucagcacccaggacgagaagggcgucacccagaacgggcggcugaucacggcgaacccgaucgugaccgacaaggagaagcccgugaacaucgaggccgagccgcccuucggcgaguccuacaucgucaucggcgccggggagaaggcccugaagcucagcugguucaagaagggcuccagcaucgggaagauguucgaggcgaccgcccgcggcgcccggcgcauggccauccugggggacaccgccugggacuucggcuccaucggcgggguguucacgagcgugggcaagcugguccaccagaucuucgggaccgcguacggcguccucuucuccggggugagcuggaccaugaagaucggcaucggcguccugcugaccuggcucgggcugaacucccgcagcacgucccugagcaugaccugcaucgccgugggccucgugacccuguaccugggggucauggugcaggccgacuccggcugcgugaucaacuggaaggggcgggagcucaagugcggcagcggcaucuucgucaccaacgaggugcacacguggaccgagcaguacaaguuccaggccgacagcccgaagcgccuguccgccgcgaucgggaaggccugggaggagggcgugugcgggauccggagcgccacccgccuggagaacaucauguggcggcagaucuccaacgagcucaaccacauccugcuggagaacgacaugaaguucaccgucguggugggcgacgucguggggauccucgcccagggcaagaagaugauccgcccccagcccauggagcacaaguacagcuggaaguccuggggcaaggccaagaucaucggggcggacgugcagaacaccacguucaucaucgacggccccaacaccccggagugccccgacgaccagcgggccuggaacaucugggaggucgaggacuacggguucggcaucuucaccaccaacaucuggcugaagcugcgcgacagcuacacccaggugugcgaccaccggcucauguccgccgccaucaaggacagcaaggcggugcacgccgacaugggcuacuggaucgaguccgagaagaacgagaccuggaagcuggcccgcgccagcuucaucgaggucaagaccugcaucuggcccaagucccacacccuguggagcaacggggugcucgaguccgagaugaucauccccaagaucuacggcgggccgaucagccagcacaacuaccggcccggcuacuucacgcagaccgccgggcccuggcaccugggcaagcuggagcucgacuucgaccugugcgagggcaccaccguggucguggacgagcacugcgggaaccgcggcccgucccugcggacgaccaccgugaccgggaagaucauccacgaguggugcugccgcagcugcacgcugccgccccuccgguucaagggcgaggacgggugcugguacggcauggagauccgccccgucaaggagaaggaggagaaccuggugaaguccauggugagcgcgggcagcggggaggucgacuccuucagccucggccugcugugcaucuccaucaugaucgaggaggugaugcggagccgcuggucccggaagaugcucaugaccgggacccuggccguguucuuccugcucaucaugggccagcugaccuggaacgaccugauccgccucugcaucauggucggggccaacgccagcgaccgcaugggcaugggcacgaccuaccuggcccugauggcgaccuucaagaugcggccgauguucgccguggggcuccuguuccgccggcugaccucccgcgagguccuccugcugacgaucggccucagccugguggccuccguggagcugcccaacagccucgaggagcugggggacggccuggccaugggcaucaugauccucaagcugcugaccgacuuccaguccuaccagcucugggucacccugcugagccucaccuucaucaagacgaccuucucccugcacuacgccuggaagaccauggcgauggugcugagcaucgugucccuccugccccugugccucagcaccacgucccagaagaccaccuggcugcccguccugcucgggagccugggcugcaagccgcugaccauguucuucaucgccgagaacaagaucugggggcggaaguccuggccccucaacgagggcaucauggccguggggaucgugagcauccugcugagcucccuccugaagaacgacgucccccuggccggcccccucaucgcgggcgggaugcugaucgccugcuacgugaucagcggcuccagcgccgaccugucccucgagaaggccgccgaggugagcugggaggaggaggcggagcacuccggggccagccacaacauccuggucgaggugcaggacgacggcacgaugaagaucaaggacgaggagcgcgacgacacccugaccauccuccugaaggccacccugcucgccguguccggggucuacccgcugagcauccccgccacccuguucgugugguacuucuggcagaagaagaagcagcgguccggcgugcucugggacacgcccagcccgcccgaggucgagcgcgcggugcuggacgacggcaucuaccggaucaugcagcgcgggcugcugggccggucccaggugggggucggcguguuccaggagaacguguuccacaccauguggcacgucacccgcggggccgugcucauguaccagggcaagcggcuggagcccagcugggccuccgugaagaaggaccugaucagcuacggcgggggcuggcgccuccagggguccuggaacaccggcgaggagguccaggugaucgccguggagcccgggaagaaccccaagaacguccagacggcccccggcaccuucaagacccccgagggcgaggugggggcgaucgcccuggacuucaagcccggcaccagcgggucccccaucgugaaccgggagggcaagaucgucggccuguacgggaacggcguggugacgaccagcgggaccuacgucagcgccaucgcccaggccaaggcgucccaggagggcccgcuccccgagaucgaggacgagguguuccgcaagcggaaccugaccaucauggaccugcaccccgggagcggcaagacgcgccgguaccucccggccaucgugcgcgaggccaucaagcggaagcugcgcacccugauccucgcccccacccgcgucguggcguccgagauggccgaggcccugaagggcaugcccauccgguaccagaccacggccgucaagagcgagcacaccgggcgcgagaucgucgaccugaugugccacgccaccuucaccaugcggcuccugucccccgugcgcgugccgaacuacaacaugaucaucauggacgaggcgcacuucacggaccccagcuccaucgccgcccggggcuacaucagcacccgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgaguggaucacggacuuccccggcaagaccgucugguucgugcccuccaucaagagcgggaacgacaucgccaacugccugcggaagaacggcaagcgcgugauccagcucucccggaagaccuucgacaccgaguaccagaagacgaagaacaacgacugggacuacgucgugaccaccgacaucagcgagaugggggcgaacuuccgcgccgaccgggucaucgacccgcgccggugccugaagcccgugauccugaaggacggccccgagcgcgugauccucgccgggcccaugccggucaccguggccuccgcggcccagcggcgcggccggaucggccgcaaccacaacaaggagggggaccaguacaucuacaugggccagccccugaacaacgacgaggaccacgcccacuggacggaggccaagaugcugcucgacaacaucaacacccccgaggggaucauccccgcccuguucgagccggagcgcgagaaguccgcggccaucgacggcgaguaccggcugcgcggggaggcccggaagaccuucguggagcucaugcgccggggcgaccugcccgucuggcuguccuacaagguggccagcgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcacguacuccgacccccucgcgcugcgggaguucaaggaguucgccgccgggcgccggagcaucuccggcgaccugauccucgagaucggcaagcugccgcagcaccugacccagcgcgcccagaacgcccucgacaaccuggugaugcugcacaacagcgagcagggcggccgggcguaccgccacgccauggaggagcuccccgacaccaucgagacccugaugcugcucgcccugaucgccgugcugaccgggggcgucacccucuucuuccuguccgggcggggccugggcaagaccagcaucgggcuccugugcgugauggcguccagcgcccugcucuggauggccuccguggagccccacuggaucgccgccagcaucauccuggaguucuuccugaugguccuccugauccccgagccggaccgccagcggacgccccaggacaaccagcuggcguacguggugaucggccuccuguucaugauccugaccgucgccgccaacgagauggggcuccuggagacgaccaagaaggaccugggcaucgggcacguggccguggagaaccaccaccacgccaccaugcucgacgucgaccugcaccccgcguccgccuggacccuguacgccguggccacgaccaucaucaccccgaugaugcgccacaccaucgagaacacgaccgccaacaucagccucaccgcgaucgccaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggcgaaggccacccgcgaggcccagaagcggaccgccgccgggaucaugaagaaccccaccgucgacggcaucguggcgaucgaccuggaccccguggucuacgacgccaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgugagcauggcgaacaucuuccggggcuccuaccuggccggcgccgggcuggccuucagccucaugaagucccugggcgggggccgccgggggaccggcgcccagggcgagacccugggggagaaguggaagcgccagcucaaccagcuguccaagagcgaguucaacaccuacaagcgguccggcauccuggagguggaccgcagcgaggcgaaggaggggcuccggcgcggcgagacgaccaagcacgccgucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacacgaagggcggccccgggcacgaggagcccaucccgauggcgaccuacggcuggaaccuggucaagcugcacuccgggaaggacguguucuucaucccgcccgagaagugcgacacccuccugugcgacaucggcgagagcucccccaacccgaccaucgaggaggggcggacgcugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacccacgagauguacuggguguccugcggcaccgggaacaucgugagcgccgucaacaugaccucccgcaugcuccugaaccgguucacgauggcccaccgcaagcccaccuacgagcgggacguggaccugggcgccggcacccgccacguggccgucgagcccgagguggcgaaccucgacaucaucgggcagcggaucgagaacaucaagcacgagcacaagagcaccuggcacuacgacgaggacaaccccuacaagacgugggccuaccacggcuccuacgaggucaagccgagcggguccgccagcagcauggugaacggcguggucaagcugcugaccaagcccugggacgugauccccauggugacccagaucgccaugaccgacacgacccccuucgggcagcagcgcgucuucaaggagaagguggacacccggaccccgaaggccaagcgcggcacggcgcagaucauggaggugaccgccggcuggcucuggggguuccugucccggaacaagaagccccgcaucugcacccgggaggaguucacccgcaagguccggagcaacgccgccaucggcgccguguucguggacgagaaccaguggaacuccgcgaaggaggccgucgaggacgagcgcuucugggaccuggugcaccgggagcgcgagcuccacaagcaggggaagugcgccacgugcguguacaacaugaugggcaagcgggagaagaagcugggggaguucggcaaggccaagggcagccgcgcgaucugguacauguggcugggggcccgguuccucgaguucgaggcccugggcuucaugaacgaggaccacugguucucccgcgagaacagccuguccggggucgagggcgaggggcuccacaagcugggcuacauccugcgggacaucagcaagauccccggcgggaacauguacgccgacgacaccgccggcugggacacccgcaucaccgaggacgaccuccagaacgaggcgaagaucacggacaucauggagccggagcacgcccugcuggccaccuccaucuucaagcucaccuaccagaacaagguggugcgcguccagcggcccgccaagaacgggaccgugauggacgugaucagccgccgggaccagcgcggcuccggccaggucgggacguacggccugaacaccuucaccaacauggaggcccagcugauccggcagauggagagcgaggggaucuucucccccagcgagcucgagacccccaaccuggcggagcgcgugcuggacuggcucgagaaguacggcguggagcggcugaagcgcauggccaucuccggggacgacugcgucgugaagccgaucgacgaccgguucgccacggcccugaccgcccucaacgacaugggcaaggugcgcaaggacaucccccagugggagcccagcaagggcuggaacgacuggcagcagguccccuucugcucccaccacuuccaccagcugaucaugaaggacgggcgggagaucguggugccgugccgcaaccaggacgagcuggucggccgggcgcgcgugagccagggggccggcuggagccuccgggagaccgccugccuggggaaguccuacgcccagauguggcagcugauguacuuccaccgccgggaccuccgccuggccgcgaacgccaucugcagcgccgugcccgucgacugggugcccaccucccggacgaccuggagcauccacgcccaccaccaguggaugaccaccgaggacaugcuguccguguggaaccgcgucuggaucgaggagaaccccuggauggaggacaagacgcacaucagcuccugggaggacgugccguaccucggcaagcgcgaggaccaguggugcggcagccugaucgggcugaccgcgcgggccaccugggccaccaacauccagguggccaucaaccagguccgccggcucaucggcaacgagaacuaccuggacuacaugaccuccaugaagcgcuucaagaacgagagcgacacggagggggcccugugguga

SEQ ID NO: 8022 - RNA, 9879 nt, Artificial Sequence
  derived and/or modified CDS sequence (opt1) from DENV-1__FJ639680__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugguggucggggacguggcgggcauccuggcccaggggaagaagaugauccggccccagcccauggaguacaaguacagcuggaaguccuggggcaaggccaagaucaucggcgccgacgcgcagaacacgaccuucaucaucgacgggcccaacaccccggagugccccgacgaccagcgcgccuggaacaucugggagguggaggacuacggcuucgggaucuucaccacgaacaucuggcugaagcuccgggacagcuacacccaggucugcgaccaccgccugauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggcgguguucuuccuccugaucauggggcagcugacguggaacgaccucauccgccugugcaucauggugggcgccaacgccagcgaccgcauggggaugggcaccaccuaccuggcccucauggccaccuucaagaugcggccgauguucgcggucggccugcuguuccgccggcucacgucccgcgaggugcugcugcucaccaucgggcugagccugguggccuccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgcguggaagaccauggccauggugcucagcaucgucucccuguucccccugugccucagcacgaccucccagaagaccaccuggcugcccgugcugcucggcagccuggggugcaagccgcugacgauguuccucaucgccgagaacaagaucuggggccggaaguccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggaccaugaagaucaaggacgaggagcgcgacgacacccucaccauccugcugaaggccacccuccuggccgucuccggcguguacccgcugagcauccccgccacccucuucgugugguacuucuggcagaagaagaagcagcgguccgggguccugugggacacccccagcccgcccgagguggagcgcgcggugcuggacgacggcaucuaccggaucaugcagcgcggccugcucgggcggucccaggucggcguggggguguuccaggagaacgucuuccacaccauguggcacgugacccgcggcgccgugcugauguaccaggggaagcggcuggagcccagcugggccuccgucaagaaggaccucaucagcuacggcggcggguggcgccugcagggcuccuggaacacgggggaggagguccaggugaucgccgucgagcccggcaagaaccccaagaacgugcagaccgcccccgggaccuucaagacccccgagggcgaggugggcgcgaucgcccuggacuucaagcccgggacgagcggcucccccaucgucaaccgggaggggaagaucgugggccucuacggcaacgggguggucaccaccagcggcaccuacgugagcgccaucgcccaggcgaaggccucccaggaggggccgcugcccgagaucgaggacgagguguuccgcaagcggaaccugacgaucauggaccuccaccccggcagcgggaagacccgccgguaccugccggccaucguccgcgaggccaucaagcggaagcugcgcacccucauccuggcccccacccgcgugguggcguccgagauggccgaggcccugaagggcaugcccauccgguaccagacgaccgccgucaagagcgagcacaccggcaaggagaucguggaccucaugugccacgccaccuucacgaugcgccugcugucccccgugcgggucccgaacuacaacaugaucaucauggacgaggcgcacuucaccgaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgcgaacugccuccgcaagaacgggaagcgggucauccagcugucccgcaagaccuucgacacggaguaccagaagaccaagaacaacgacugggacuacguggugaccaccgacaucagcgagaugggcgccaacuuccgggccgaccgcgucaucgacccgcggcgcugccugaagcccgugauccucaaggacgggcccgagcgggugauccuggccggccccaugccggucacgguggccuccgcggcccagcgccgggggcgcaucggccggaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgcggccaucgacggggaguaccgccuccggggcgaggcccgcaagaccuucgucgagcugaugcggcgcggggaccugcccguguggcucuccuacaagguggccagcgagggcuuccaguacagcgaccggcgcuggugcuucgacggcgagcggaacaaccagguccuggaggagaacauggacguggagaucuggacgaaggagggggagcgcaagaagcugcggccccgcuggcucgacgcccggaccuacuccgacccccuggcgcugcgcgaguucaaggaguucgccgccggccggcgcagcguguccggggaccucauccuggagaucggcaagcugccgcagcaccucacccagcgggcccagaacgcgcuggacaaccuggucaugcuccacaacagcgagcagggcgggcgcgccuaccggcacgccauggaggagcugcccgacaccaucgagacgcugaugcuccuggcccugaucgccgugcucaccggcggggugacccuguucuuccuguccggccgcgggcucggcaagaccagcaucggccugcugugcgucauggcguccagcgugcuccuguggauggccuccguggagccccacuggaucgccgccagcaucauccuggaguucuuccucaugguccugcugauccccgagccggaccggcagcgcacgccccaggacaaccagcucgccuacguggugaucgggcugcuguucaugauccucacggucgcggccaacgagaugggccugcuggagaccaccaagaaggaccucgggaucggccacguggccguggagaaccacaaccacgccgccaugcuggacgucgaccugcaccccgcguccgccuggacccucuacgccguggccacgaccaucaucaccccgaugaugcggcacaccaucgagaacacgaccgccaacaucagccugaccgcgaucgccaaccaggccgccauccugauggggcucgacaagggcuggcccaucuccaagauggacaucggcgugccccugcuggcgcucgggugcuacagccaggucaacccccugacccugacggccgccgugcucaugcugguggcccacuacgccaucaucggcccggggcugcaggcgaaggccacccgcgaggcccagaagcgcaccgccgccggcaucaugaagaaccccaccgucgacgggaucguggcgaucgaccucgaccccguggucuacgacgccaaguucgagaagcagcugggccagaucaugcugcucauccugugcacgucccagauccugcucaugcggaccaccugggcccugugcgagagcaucacccuggccacgggcccccucaccacccugugggagggguccccgggcaaguucuggaacaccacgaucgccgugagcauggcgaacaucuuccgcggguccuaccuggccggcgccggccucgccuucagccugaugaagucccucgggggcgggcggcgcgggaccggggcgcagggcgagacccucggcgagaaguggaagcggcagcugaaccagcuguccaagagcgaguucaacaccuacaagcgcuccgggaucauggagguggaccggagcgaggccaaggagggccucaagcgcggggagacgaccaagcacgccgucucccggggcaccgccaagcugcgcugguucguggagcggaaccuggugaagcccgaggggaaggucaucgaccugggcugcggccgcgggggcuggagcuacuacugcgccgggcucaagaaggugaccgaggugaagggcuacacgaagggcgggcccggccacgaggagcccaucccgauggcgaccuacggguggaaccuggucaagcugcacuccggcaaggacguguucuucaucccgcccgagaagugcgacacccuccugugcgacaucggggagagcucccccaacccgaccaucgaggagggccggacgcugcgcgugcucaagauggucgagcccuggcugcgggggaaccaguucugcaucaagauccugaaccccuacaugcccagcgugguggagacccucgagcagaugcagcgcaagcacggcggcaugcugguccggaacccgcugucccgcaacagcacccacgagauguacuggguguccugcgggaccggcaacaucgugagcgccgucaacaugaccucccggaugcuccugaaccgcuucacgauggcccaccgcaagcccaccuacgagcgggacguggaccuggggaccggcacccgccacguggccgucgagcccgagguggccaaccucgacaucaucggccagcggaucgagaacaucaagcacgagcacaagagcacguggcacuacgacgaggacaaccccuacaagaccugggcguaccacggguccuacgaggugaagccgagcggcuccgccagcagcauggucaacgggguggucaagcugcugaccaagcccugggacgugauccccauggugacccagaucgccaugacggacaccacccccuucggccagcagcgcgucuucaaggagaagguggacacccggacgccgaaggccaagcgcgggaccgcccagaucauggaggugaccgcgcgguggcucuggggcuuccugucccgcaacaagaagccccggaucugcacccgcgaggaguucacgcggaagguccgcagcaacgccgccaucggcgccguguucguggacgagaaccaguggaacuccgcgaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccggggucgagggcgaggggcuccacaagcugggcuacauccugcgcgacaucagcaagauccccgggggcaacauguacgccgacgacaccgccggcugggacacccggaucacggaggacgaccuccagaacgaggccaagaucaccgacaucauggagccggagcacgcgcugcuggccaaggccaucuucaagcucaccuaccagaacaagguggugcgcguccagcgccccgccaagaacgggaccgugauggacgugaucucccggcgcgaccagcggggcagcgggcaggucggcacguacggccugaacaccuucaccaacauggaggcccagcugauccgccagauggaguccgaggggaucuucagccccuccgagcucgagacccccaaccuggcggagcgggcccuggacuggcucgagaaguacggcguggagcgccugaagcggauggccaucagcggggacgacugcguggucaagccgaucgacgaccgcuucgccacggcccugaccgcgcucaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcuggugggccgcgcccgggucucccagggggccggcuggagccuccgcgagaccgccugccugggcaagagcuacgcgcagauguggcagcugauguacuuccaccggcgcgaccuccggcuggccgccaacgccaucugcuccgccgugcccguggacuggguccccaccagccgcacgaccugguccauccacgcgcaccaccaguggaugaccaccgaggacaugcugagcguguggaaccggguguggaucgaggagaaccccuggauggaggacaagacgcacaucuccagcugggaggacgucccguaccucggcaagcgcgaggaccaguggugcgggucccugaucggccugaccgcccgcgccaccugggccaccaacauccagguggccaucaaccaggugcggcgccucaucggcaacgagaacuaccuggacuacaugaccagcaugaagcgguucaagaacgaguccgaccccgagggggcgcugugguga

SEQ ID NO: 8023 - RNA, 9879 nt, Artificial Sequence
  derived and/or modified CDS sequence (opt1) from DENV-1__FJ639682__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaagacccugaagcucagcugguucaagaagggguccagcaucggcaagauguucgaggccacggcccgcggggcccggcgcauggccauccugggcgacaccgcgugggacuucggguccaucggcggcguguucaccagcgucgggaagcuggugcaccagaucuucggcaccgccuacgggguccuguucuccggcgucagcuggacgaugaagaucgggaucggcgugcugcugaccuggcucggccugaacucccgcagcaccucccugagcaugaccugcaucgccguggggcucgucacgcuguaccugggcgugauggugcaggccgacuccgggugcgucaucaacuggaagggccgggagcucaagugcgggagcggcaucuucgugaccaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaagcucacggugguggucggggacguggccggcauccuggcgcaggggaagaagaugauccggccccagcccauggaguacaaguacagcuggaaguccuggggcaaggccaagaucaucggcgccgacgcccagaacaccaccuucaucaucgacgggcccaacaccccggagugccccgacgaccagcgcgcguggaacaucugggagguggaggacuacggcuucgggaucuucacgaccaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagacgugcaucuggcccaagucccacacccucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcacgaccgugguggucgacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacgcuggccguguucuuccuccugaucauggggcagcugaccuggaacgaccucauccgccugugcaucauggugggcgcgaacgccagcgaccgcauggggaugggcaccaccuaccuggcccucauggccacguucaagaugcggccgauguucgccgucgggcugcuguuccgccggcucaccucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacgcugcucagccugaccuucaucaagaccaccuucucccugcacuacgccuggaagacgauggcgauggugcucagcaucgucucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggccgugggcaucgucagcauccugcucagcucccugcugaagaacgacgugccccucgccgggccccugaucgccggcggcaugcugaucgcgugcuacgugcucagcggguccagcgccgaccugucccuggagaaggccgccgaggucagcugggaggaggaggccgagcacuccggcgcgagccacaacauccucguggaggugcaggacgacgggaccaugaagaucaaggacgaggagcgcgacgacacccugaccauccugcucaaggccacgcugcuggccgucuccggcguguacccgcucagcauccccgccacccuguucgugugguacuucuggcagaagaagaagcagcgguccgggguccugugggacacccccagcccgcccgagguggagcgcgccgugcuggacgacggcaucuaccggaucaugcagcgcggccuccuggggcggucccaggucggcguggggguguuccaggagaacgucuuccacaccauguggcacgugacgcgcggcgcggugcugauguaccaggggaagcggcucgagcccagcugggccuccgucaagaaggaccugaucagcuacggcggcggguggcgccugcagggcuccuggaacaccggggaggagguccaggugaucgccgucgagcccggcaagaaccccaagaacgugcagaccgcccccgggaccuucaagacgcccgagggcgaggugggcgccaucgcgcucgacuucaagcccgggaccagcggcucccccaucgucaaccgggaggggaagaucgugggccuguacggcaacgggguggucaccaccagcggcacguacgugagcgccaucgcccaggccaaggcgucccaggaggggccgcugcccgagaucgaggacgagguguuccgcaagcggaaccucaccaucauggaccugcaccccggcagcgggaagacccgccgguaccugccggccaucguccgcgaggccaucaagcggaagcuccgcacccugauccuggcccccacgcgcgugguggccuccgagauggcggaggcccucaagggcauccccauccgguaccagaccaccgccgucaagagcgagcacaccggcaaggagaucguggaccugaugugccacgccacguucaccaugcgccugcucucccccgugcgggucccgaacuacaacaugaucaucauggacgaggcccacuucaccgaccccagcuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgcgaacuuccgggccgaccgcgucaucgacccgcggcgcugccucaagcccgugauccugaaggacgggcccgagcgggugauccuggccggccccaugccggucaccguggccuccgccgcgcagcgccgggggcgcaucggccggaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccgccugcggggcgaggcccgcaagacguucgucgagcugaugcggcgcggggaccuccccguguggcuguccuacaagguggccagcgagggcuuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccgcagcaccugacccagcgggcccagaacgcccuggacaaccucgucaugcugcacaacagcgagcagggcgggcgcgcguaccggcacgccauggaggagcugcccgacacgaucgagacccucaugcugcuggcccucaucgccgugcugaccggcggggugacccuguucuuccucuccggccgcgggcugggcaagaccagcaucggccugcucugcgucauggccuccagcgugcugcuguggauggcguccguggagccccacuggaucgccgccagcaucauccucgaguucuuccugaugguccugcucauccccgagccggaccggcagcgcacgccccaggacaaccagcuggccuacguggugaucgggcuccucuucaugauccugaccgucgccgcgaacgagaugggccugcucgagaccaccaagaaggaccuggggaucggccacguggccguggagaaccaccaccacgccgccaugcuggacgucgaccuccaccccgccuccgcguggacgcuguacgccguggccaccaccaucaucaccccgaugaugcggcacacgaucgagaacaccaccgccaacaucagccugaccgccaucgcgaaccaggccgccauccucauggggcuggacaagggcuggcccaucuccaagauggacaucggcgugccccugcucgcccuggggugcuacagccaggucaacccccugacgcucaccgcggccgugcugaugcugguggcccacuacgccaucaucggcccggggcuccaggccaaggcgacccgcgaggcccagaagcgcaccgccgccggcaucaugaagaaccccacggucgacgggaucguggccaucgaccuggaccccguggucuacgacgcgaaguucgagaagcagcugggccagaucaugcuccugauccugugcaccucccagauccuccugaugcggaccaccugggcccugugcgagagcaucacgcucgccaccggcccccugaccacccugugggagggguccccgggcaaguucuggaacacgaccaucgccgugagcauggccaacaucuuccgcggguccuaccucgcgggcgccggccuggccuucagccugaugaagucccucgggggcgggcggcgcggcaccggggcccagggcgagacccugggcgagaaguggaagcggcagcugaaccagcucuccaagagcgaguucaacacguacaagcgcuccgggaucauggagguggaccggagcgaggcgaaggagggccugaagcgcggggagaccaccaagcacgccgucucccggggcaccgccaagcugcgcugguucguggagcggaaccuggugaagcccgaggggaaggucaucgaccucggcugcggccgcgggggcuggagcuacuacugcgccgggcugaagaaggugacggaggugaagggcuacaccaagggcgggcccggccacgaggagcccaucccgauggccaccuacggguggaaccuggucaagcuccacuccggcaaggacguguucuucaucccgcccgagaagugcgacacccugcugugcgacaucggggagagcucccccaacccgacgaucgaggagggccggacccuccgcgugcugaagauggucgagcccuggcugcgggggaaccaguucugcaucaagauccucaaccccuacaugcccagcgugguggagacccuggagcagaugcagcgcaagcacggcggcaugcugguccggaacccgcucucccgcaacagcacccacgagauguacuggguguccugcgggaccggcaacaucgugagcgcggucaacaugacgucccggaugcugcugaaccgcuucaccauggcccaccgcaagcccaccuacgagcgggacguggaccucgggaccggcacgcgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggugaagccgagcggcuccgcgagcagcauggucaacgggguggucaagcugcucaccaagcccugggacgugauccccauggugacgcagaucgccaugaccgacaccacccccuucggccagcagcgcgucuucaaggagaagguggacacgcggaccccgaaggccaagcgcgggaccgcccagaucauggaggugaccgcccgguggcuguggggcuuccugucccgcaacaagaagccccggaucugcacgcgcgaggaguucacccggaagguccgcagcaacgcggccaucggcgccguguucguggacgagaaccaguggaacuccgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaaggggagccgggccaucugguacauguggcucggcgcccgcuuccuggaguucgaggcgcugggcuucaugaacgaggaccacugguucucccgggagaacagccucuccggggucgagggcgaggggcugcacaagcugggcuacauccuccgcgacaucagcaagauccccgggggcaacauguacgccgacgacaccgccggcugggacacgcggaucaccgaggacgaccugcagaacgaggccaagaucaccgacaucauggagccggagcacgcccugcucgcgaaggccaucuucaagcugaccuaccagaacaagguggugcgcguccagcgccccgccaagaacgggacggugauggacgugaucucccggcgcgaccagcggggcagcgggcaggucggcaccuacggccugaacaccuucaccaacauggaggcccagcucauccgccagauggaguccgaggggaucuucagccccuccgagcuggagacgcccaaccuggccgagcgggcgcucgacuggcuggagaaguacggcguggagcgccugaagcggauggccaucagcggggacgacugcguggucaagccgaucgacgaccgcuucgccaccgcccucaccgcccugaacgacaugggcaaggugcggaaggacaucccccagugggagcccuccaagggguggaacgacuggcagcagguccccuucugcagccaccacuuccaccagcugaucaugaaggacggccgcgagaucgucgugccgugccggaaccaggacgagcucgugggccgcgcgcgggucucccagggggccggcuggagccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccugguccauccacgcccaccaccaguggaugaccacggaggacaugcucagcguguggaaccggguguggaucgaggagaaccccuggauggaggacaagacccacaucuccagcugggaggacgucccguaccugggcaagcgcgaggaccaguggugcgggucccugaucggccucaccgcgcgcgccaccugggccaccaacauccagguggccaucaaccaggugcggcgccugaucggcaacgagaacuaccuggacuacaugacgagcaugaagcgguucaagaacgaguccgaccccgagggggcccucugguga

SEQ ID NO: 8024 - RNA, 9879 nt, Artificial Sequence
  derived and/or modified CDS sequence (opt1) from DENV-1__JQ287664__SS-prME
agcgugaccaugcugcucaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagguggagcccgacgacguggacugcuggugcaacaccacggacaccugggugaccuacgggaccugcagccagacgggcgagcaccggcgcgacaagcgguccguggcccucgcgccccacgucggccuggggcuggagacccgcgccgagaccuggaugagcuccgagggcgcguggaagcagauccagcggguggagaccugggcccuccgccaccccggguucacggugaucgcccuguuccuggcccacgucaucggcaccagcaucacccagaaggggaucaucuucauccuccugaugcuggugacccccuccauggcgaugcggugcgugggcaucggcagccgcgacuucgucgaggggcucuccggcgccacguggguggacgugguccuggagcacgggagcugcgugaccaccauggccaaggacaagcccacccuggacaucgagcuccugaagacggaggugaccaaccccgccguccugcggaagcucugcaucgaggccaagaucuccaacaccaccacggacagccgcugcccgacccagggcgaggcgacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccguccacaccggcgaccagcaccagguggggaacgaguccacggagcacggcaccaccgccaccaucacgccccaggcccccacgagcgagauccagcucaccgacuacggggcgcugacccuggacugcagcccccggaccggccucgacuucaacgagauggugcugcugacgaugaaggagaaguccuggcucguccacaagcagugguuccuggaccugccccuccccuggaccagcggggccuccaccagccaggagaccuggaaccggcaggaccugcuggugacguucaagaccgcccacgccaagaagcaggagguggucgugcucggcucccaggagggcgccaugcacaccgcgcugaccggggccacggagauccagaccagcggcaccaccacgaucuucgccgggcaccugaagugccgccucaagauggacaagcugacccugaagggcauguccuacgugaugugcaccgggagcuucaagcucgagaaggaggucgccgagacccagcacggcacggugcuggugcagaucaaguacgagggcaccgacgcccccugcaagauccccuucuccacccaggacgagaagggggucacccagaacggccggcugaucacggcgaacccgaucgugaccgacaaggagaagcccgugaacaucgaggccgagccgcccuucggggagagcuacaucgucaucggcgccggcgagaaggcccugaagcucuccugguucaagaaggggagcuccaucggcaagauguucgaggcgaccgcccgcggggcccggcgcauggccauccugggcgacaccgccugggacuucgggagcaucggcggcguguucacguccguggggaagcugguccaccagaucuucggcaccgcguacggggugcuguucagcggcguguccuggaccaugaagaucgggaucggcguccugcugaccuggcucggccugaacagccgcuccacgagccuguccaugaccugcaucgccguggggcucgugacccuguaccugggcgucauggugcaggccgacagcgggugcgugaucaacuggaagggccgggagcucaagugcgggagcggcaucuucgucaccaacgaggugcacacguggaccgagcaguacaaguuccaggccgacuccccgaagcgccugagcgccgcgaucggcaaggccugggaggagggggugugcggcauccgguccgccacccgccuggagaacaucauguggcggcagaucagcaacgagcucaaccacauccugcuggagaacgacaugaaguucaccgucguggugggggacgucgugggcauccucgcccaggggaagaagaugauccgcccccagcccauggagcacaaguacuccuggaaguccuggggcaaggccaagaucaucggcgcggacgugcagaacaccacguucaucaucgacgggcccaacaccccggagugccccgacgaccagcgggccuggaacaucugggaggucgaggacuacggcuucgggaucuucaccaccaacaucuggcugaagcugcgcgacuccuacacccaggugugcgaccaccggcucaugagcgccgccaucaaggacuccaaggcggugcacgccgacaugggcuacuggaucgagagcgagaagaacgagaccuggaagcuggcccgcgccuccuucaucgaggucaagaccugcaucuggcccaagagccacacccugugguccaacggcgugcucgagagcgagaugaucauccccaagaucuacgggggcccgaucucccagcacaacuaccggcccggguacuucacgcagaccgccggccccuggcaccuggggaagcuggagcucgacuucgaccugugcgagggcaccaccguggucguggacgagcacugcggcaaccgcgggccgagccugcggacgaccaccgugaccggcaagaucauccacgaguggugcugccgcuccugcacgcugccgccccuccgguucaagggggaggacggcugcugguacgggauggagauccgccccgucaaggagaaggaggagaaccuggucaagagcauggugagcgcgggcuccggcgaggucgacagcuucucccucgggcugcugugcaucagcaucaugaucgaggaggugaugcggucccgcuggagccggaagaugcucaugaccggcacccuggccguguucuuccugcucaucauggggcagcugaccuggaacgaccugauccgccucugcaucauggucggcgccaacgccuccgaccgcauggggaugggcacgaccuaccuggcccugauggcgaccuucaagaugcggccgauguucgccgugggccuccuguuccgccggcugaccagccgcgagguccuccugcugacgaucgggcucucccugguggccagcguggagcugcccaacucccucgaggagcugggcgacgggcuggccaugggcaucaugauccucaagcugcugaccgacuuccagagcuaccagcucugggccacccugcugucccucaccuucaucaagacgaccuucagccugcacuacgcguggaagaccauggccaugguccuguccaucgugagccuccugccccugugccucuccaccacgagccagaagaccaccuggcugcccgugcugcucggcucccuggggugcaagccgcugaccauguucuucaucgccgagaacaagaucuggggccgcaagagcuggccccucaacgaggggaucauggccgucggcaucgugagcauccugcuguccagccuccugaagaacgacgugccccuggcggggccccucaucgccggcggcaugcugaucgccugcuacgucaucuccgggagcuccgccgaccugagccucgagaaggccgcggagguguccugggaggaggaggccgagcacagcggcgccucccacaacauccugguggagguccaggacgacgggacgaugaagaucaaggacgaggagcgcgacgacacccugaccauccuccugaaggccacccugcucgccgugagcggcguguacccgcuguccauccccgcgacccuguucgucugguacuucuggcagaagaagaagcagcggagcggggugcucugggacacgcccagcccgcccgagguggagcgcgccguccuggacgacggcaucuaccggaucaugcagcgcggccugcuggggcggagccaggugggcgugggggucuuccaggagaacguguuccacaccauguggcacgugacccgcggcgccguccucauguaccaggggaagcggcuggagcccuccugggccagcgugaagaaggaccugaucuccuacggcggcggguggcgccuccagggcagcuggaacaccggggaggaggugcaggucaucgccguggagcccggcaagaaccccaagaacgugcagacggcgcccgggaccuucaagacccccgagggcgaggucggcgccaucgcccuggacuucaagcccgggaccuccggcagccccaucgugaaccgggaggggaagaucgugggccuguacggcaacggggucgugacgaccagcggcaccuacguguccgccaucgcccaggcgaaggccagccaggaggggccgcuccccgagaucgaggacgaggucuuccgcaagcggaaccugaccaucauggaccugcaccccggcuccgggaagacgcgcaaguaccucccggccaucgugcgggaggccaucaagcgcaagcugcggacccugauccucgcgcccacccgcguggucgccagcgagauggccgaggcccugaagggcaugcccauccgcuaccagaccacggccgugaaguccgagcacaccggccgggagaucguggaccugaugugccacgcgaccuucaccaugcgccuccugagccccguccgggugccgaacuacaacaugaucaucauggacgaggcccacuucacggaccccuccagcaucgccgcccgcggguacaucuccacccgggugggcaugggggaggccgcggccaucuucaugaccgccacgccgcccggcagcgucgaggccuucccgcaguccaacgccgugauccaggacgaggagcgcgacauccccgagcggagcuggaacuccggguacgaguggaucacggacuuccccggcaagaccgugugguucguccccagcaucaaguccggcaacgacaucgcgaacugccugcgcaagaacgggaagcgggugauccagcucagccgcaagaccuucgacaccgaguaccagaagacgaagaacaacgacugggacuacguggucaccaccgacaucuccgagaugggcgccaacuuccgggccgaccgcgugaucgacccgcggcgcugccugaagcccgucauccugaaggacgggcccgagcgggugauccucgccggccccaugccggugaccgucgcgagcgccgcccagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcgcuguucgagccggagcgcgagaaguccgccgccaucgacggggaguaccgccugcggggcgaggcccgcaagaccuucguggagcucaugcggcgcggggaccugcccguguggcugagcuacaaggucgccagcgagggcuuccaguacuccgaccggcgcuggugcuucgacggcgagcggaacaaccaggugcucgaggagaacauggacguggagaucuggaccaaggagggggagcgcaagaagcugcggccccgcuggcuggacgcgcggacguacagcgacccccucgcccugcgcgaguucaaggaguucgccgccggccggcgcuccaucagcggggaccugauccucgagaucggcaagcugccgcagcaccugacccagcgggcccagaacgcgcucgacaaccuggucaugcugcacaacuccgagcagggcgggcgcgccuaccggcacgccauggaggagcuccccgacaccaucgagacccugaugcugcucgcccugaucgcggugcugacgggcggggugacccucuucuuccugagcggccgcgggcugggcaagaccuccaucggccuccugugcgucauggccagcuccgcccugcucuggauggccagcguggagccccacuggaucgccgcguccaucauccuggaguucuuccugauggugcuccugauccccgagccggaccggcagcgcacgccccaggacaaccagcuggccuacgucgugaucgggcuccuguucaugauccugaccguggccgccaacgagaugggccuccuggagacgaccaagaaggaccuggggaucggccacgucgccguggagaaccaccaccacgcgaccaugcucgacguggaccugcaccccgccagcgccuggacccuguacgccgucgccacgaccaucaucaccccgaugaugcggcacaccaucgagaacacgaccgcgaacaucucccucaccgccaucgccaaccaggccgccauccugauggggcuggacaagggcuggcccaucagcaagauggacaucggcgugccccuccuggcgcuggggugcuacucccaggugaacccccucacccugacggccgccguccugaugcucguggcccacuacgcgaucaucggcccggggcugcaggccaaggccacccgcgaggcccagaagcgcaccgccgcgggcaucaugaagaaccccaccguggacgggaucgucgccaucgaccuggaccccgugguguacgacgccaaguucgagaagcagcucggccagaucaugcugcugauccucugcacgagccagauccugcugaugcggaccaccugggcccucugcgaguccaucacccuggccacgggcccccugaccacccucugggaggggagcccgggcaaguucuggaacaccacgaucgcggucuccauggccaacaucuuccgcgggagcuaccuggccggcgccggccuggccuucagccucaugaagucccucgggggcgggcggcgcgggaccggggcgcagggcgagacccugggcgagaaguggaagcggcagcucaaccagcugagcaaguccgaguucaacaccuacaagcgcagcgggauccuggagguggaccgguccgaggccaaggagggccuccgccgcggggagacgaccaagcacgccgugagccgcggcaccgccaagcugcggugguucgucgagcgcaaccuggugaagcccgaggggaaggugaucgaccugggcugcggccgcggcgggugguccuacuacugcgcggggcucaagaaggucaccgaggugaagggguacacgaagggcgggcccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccgcacgcugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugaccagccgcaugcuccugaaccgcuucacgauggcccaccggaagcccaccuacgagcgcgacgucgaccugggggccggcacccggcacguggcgguggagcccgaggucgccaaccucgacaucaucggccagcgcaucgagaacaucaagcacgagcacaaguccaccuggcacuacgacgaggacaaccccuacaagacgugggccuaccacgggagcuacgaggugaagccguccggcagcgccagcuccauggucaacgggguggugaagcugcugaccaagcccugggacgucauccccauggugacccagaucgccaugaccgacacgacccccuucggccagcagcggguguucaaggagaaggucgacacccgcaccccgaaggcgaagcgggggacggcccagaucauggaggugaccgcccgcuggcucuggggcuuccugagccggaacaagaagccccgcaucugcacccgggaggaguucacccgcaaggugcgguccaacgccgccaucggcgcggucuucguggacgagaaccaguggaacagcgccaaggaggccguggaggacgagcgcuucugggaccugguccaccgggagcgcgagcuccacaagcaggggaagugcgccacgugcguguacaacaugaugggcaagcgggagaagaagcugggggaguucggcaaggcgaaggggucccgcgccaucugguacauguggcugggcgcccgguuccucgaguucgaggcccugggcuucaugaacgaggaccacugguucagccgcgagaacucccugagcgggguggagggcgaggggcuccacaagcugggcuacauccugcgggacaucuccaagauccccgggggcaacauguacgccgacgacaccgcgggcugggacacccgcaucaccgaggacgaccuccagaacgaggccaagaucacggacaucauggagccggagcacgcccugcuggccaccagcaucuucaagcucaccuaccagaacaaggucgugcgcgugcagcggcccgccaagaacgggaccgucauggacgugaucucccgccgggaccagcgcggcagcggccaggugggcacguacggccugaacaccuucaccaacauggaggcgcagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgccacggcccugaccgcgcucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucagccagggggccggcuggucccuccgggagaccgccugccugggcaagagcuacgcccagauguggcagcugauguacuuccaccgccgggaccuccgccuggcggccaacgccaucugcuccgccgugcccuucgacugggugcccaccagccggacgaccugguccauccacgcgcaccaccaguggaugaccaccgaggacaugcugagcgucuggaaccgcguguggaucgaggagaaccccuggauggaggacaagacgcacaucuccagcugggaggacgugccguaccucggcaagcgcgaggaccaguggugcgggucccugaucggccugaccgcccgggccaccugggccaccaacauccaggucgccaucaaccaggugcgccggcucaucggcaacgagaacuaccuggacuacaugaccagcaugaagcgcuucaagaacgaguccgacacggagggggcgcugugguga

SEQ ID NO: 8025 - RNA, 9879 nt, Artificial Sequence
  derived and/or modified CDS sequence (opt1) from DENV-1__FJ639683__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcucaagcugcgggacagcuacacccaggucugcgaccaccgccugauguccgccgccaucaaggacagcaaggccgugcacgccgacaugggcuacuggaucgaguccgagaagaacgagaccuggaagcucgcgcgggccagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaagucccuggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcgggcacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucgugccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgcggugaacaugaccucccgcaugcuccugaaccgcuucacgauggcccaccggaagcccaccuacgagcgcgacguggaccugggcgccggcacccggcacgucgccguggagcccgagguggccaaccucgacaucaucgggcagcgcaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgcgaaguggcucuggggcuuccugucccgcaacaagaagccccggaucugcacccgcgaggaguucacccggaaggugcgcagcaacgccgccaucggggccguguucgucgacgagaaccaguggaacuccgcgaaggaggccguggaggacgagcgguucugggaccuggugcaccgcgagcgggagcuccacaagcagggcaagugcgccacgugcgucuacaacaugauggggaagcgcgagaagaagcugggcgaguucgggaaggccaagggcagccgggccaucugguacauguggcugggcgcgcgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccggaucaccgaggacgaccuccagaacgaggcccgcaucacggacaucauggagccggagcacgcgcugcuggccaaguccaucuucaagcucaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcugauccggcagauggagagcgagggcaucuucucccccagcgagcucgagacccccaaccuggccgagcgcgugcuggacuggcucgagaaguacggggucgagcggcugaagcgcauggcgaucuccggcgacgacugcguggugaagccgaucgacgaccgguucgccaccgcccugacggcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgcgggguggagccuccgggagaccgccugccugggcaaguccuacgcccagauguggcagcugauguacuuccaccgccgggaccuccgccuggccgcgaacgccaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccucggcaagcgcgaggaccaguggugcggcagccugaucgggcugacggcccgggcgaccugggccaccaacauccagguggccaucaaccagguccgccggcucaucggcaacgagaacuaccuggacuacaugaccuccaugaagcgcuucaagaacgagagcgaccccgagggggcccugugguga

SEQ ID NO: 8026 - RNA, 9879 nt, Artificial Sequence
  derived and/or modified CDS sequence (opt1) from DENV-1__FJ639684__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgcgaacuuccgcgccgaccgggugaucgacccccgccggugccucaagccggugauccugaaggacgggcccgagcgcgucauccuggccggccccaugcccgugaccgucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccgugcugaccggcggggucacccuguucuuccucagcggccgggggcugggcaagacguccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccagcgcguggacgcuguacgccguggccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgucccccugcucgcccuggggugcuacucccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggcgaaggagggccugaagcgcggggagaccaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugacggaggucaagggguacaccaagggcgggcccggccacgaggagcccauccccauggccaccuacggguggaaccuggugaagcuccacagcggcaaggacguguucuucgucccgcccgagaagugcgacacccugcugugcgacaucggggaguccagccccaaccccacgaucgaggagggccgcacccuccgggugcugaagaugguggagccguggcugcgcgggaaccaguucugcaucaagauccucaaccccuacaugcccuccgucguggagacccuggagcagaugcagcggaagcacggcggcaugcuggugcgcaacccccucagccggaacuccacccacgagauguacugggucagcugcgggacgggcaacaucguguccgcggugaacaugaccagccgcaugcugcugaaccgguucaccauggcccaccgcaagccgaccuacgagcgcgacgucgaccucggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagcccagcggcuccgccagcuccauggucaacgggguggugaagcugcucaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccugagccgcaacaagaagccgcggaucugcacccgcgaggaguucacgcggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggucgugcgcgugcagcggcccgccaagaacgggaccgucauggacgugaucagccgccgcgaccagcggggcuccggccaggugggcacguacggccugaacaccuucaccaacauggaggcccagcucauccgccagauggagagcgaggggaucuucuccccgagcgagcuggagacccccaaccuggccgagcgggcgcucgacuggcuggagaagcacggcgucgagcgccugaagcggauggccaucagcggggacgacugcguggugaagcccaucgacgaccgcuucgccacggcccucaccgcccugaacgacaugggcaagguccggaaggacaucccccagugggagccguccaagggguggaacgacuggcagcagguccccuucugcagccaccacuuccaccagcugaucaugaaggacggccgcgagaucgugguccccugccggaaccaggacgagcucgugggccgcgcgcgggugucccagggggccggcuggagccugcgcgagaccgccugccuggggaaguccuacgcccagauguggcagcucauguacuuccaccggcgcgaccugcggcuggcggccaacgccaucugcagcgccguccccguggacugggugccgaccucccgcacgaccuggagcauccacgcccaccaccaguggaugaccaccgaggacaugcucuccgucuggaaccggguguggaucgaggagaaccccuggauggaggacaagacgcacaucagcuccugggaggacgugcccuaccugggcaagcgcgaggaccaguggugcgggagccugaucggccucaccgcgcgggccaccugggccaccaacauccaggucgccaucaaccaggugcgccgccugaucggcaacgagaacuaccuggacuacaugacguccaugaagcgguucaagaacgagagcgugcccgagggggcccucugguga

SEQ ID NO: 8027 - RNA, 9879 nt, Artificial Sequence
  derived and/or modified CDS sequence (opt1) from DENV-1__FJ639685__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcucaagcugcgggacagcuacacccaggucugcgaccaccgccugauguccgccgccaucaaggacagcaaggccgugcacgccgacaugggcuacuggaucgaguccgagaagaacgagaccuggaagcucgcgcgggccagcuucaucgaggugaagaccugcaucuggcccaagucccacacgcuguggagcaacggcguccuggaguccgagaugaucauccccaagaucuacgggggcccgaucagccagcacaacuaccgccccggguacuucacccagaccgccggccccuggcaccucgggaagcuggagcuggacuucgaccucugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccuggggcuccugugcaucuccaucaugaucgaggaggucaugcggagccgcuggucccggaagaugcugaugaccggcacccucgccguguuccugcugcucaucauggggcagcugacguggaacgaccugauccgccucugcaucauggugggcgcgaacgccagcgaccgcauggggaugggcaccaccuaccuggcccugauggccaccuucaagaugcggccgauguucgccgucgggcuccuguuccgccggcugacgucccgcgaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccggcgcuccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgggacgacacccugaccauccuccugaaggccacccugcucgccgucuccggcguguacccgcugagcauccccgccacgcuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgcggugcucauguaccaggggaagcgccuggagcccagcugggccuccgucaagaaggaccugaucagcuacggcggcggguggcggcuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcuccccgagaucgaggacgagguguuccggaagcgcaaccugacgaucauggaccugcaccccggcagcgggaagacccggcgcuaccucccggccaucguccgggaggccaucaagcgcaagcugcgcacccugauccucgcccccacccgggugguggccuccgagauggcggaggcccugaagggcaugcccauccgcuaccagacgaccgccgucaagagcgagcacaccggcaaggagaucguggaccugaugugccacgccaccuucacgaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccugaaggacgggcccgagcgcgugauccucgccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgccauggaggagcuccccgacaccaucgagacgcugaugcugcucgcccugaucgccgugcugaccggcggggugacccucuucuuccuguccggccgggggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucgggcuccuguucaugauccugacggucgccgcgaacgagaugggccuccuggagaccaccaagaaggaccuggggaucggccacguggccgccgggaaccaccaccacgccgccaugcucgacguggaccugcaccccgcguccgccuggacccuguacgccgucgccacgaccaucaucaccccgaugaugcgccacaccaucgagaacacgaccgccaacaucagccucaccgcgaucgccaaccaggccgccauccugaugggccuggacaagggcuggcccaucuccaagauggacaucggggugccccuccuggcgcugggcugcuacagccaggugaacccccucacccugacggccgccguccugaugcucguggcccacuacgccaucaucgggccgggccugcaggcgaaggccacccgcgaggcccagaagcggaccgccgccgggaucaugaagaaccccaccguggacggcaucgucgcgaucgaccuggaccccgugguguacgacgccaaguucgagaagcagcucggccagaucaugcugcugauccucugcacgucccagauccugcugaugcgcaccaccugggcccucugcgagagcaucacccuggccacggggccccugaccacccucugggagggcuccccggggaaguucuggaacaccacgaucgccgucagcauggcgaacaucuuccggggcuccuaccuggccggcgccgggcuggccuucagcgugaugaagucccucggcgggggccgccgggggaccggcgcgcagggcgagacccugggggagaaguggaagcgccagcugaaccagcucuccaagagcgaguucaacaccuacaagcgguccggcaucauggagguggaccgcagcgaggccaaggaggggcugaagcggggcgagacgaccaagcacgccgucucccgcgggaccgccaagcugcggugguucguggagcgcaaccucgugaagcccgagggcaaggucaucgaccugggcugcgggcggggcggguggagcuacuacugcgccggccugaagaaggugaccgaggugaagggguacacgaagggcggccccgggcacgaggagcccaucccgauggcgaccuacggcuggaaccuggucaagcuccacuccgggaaggacguguucuucgugccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgccgugaacaugaccucccgcaugcugcugaaccgcuucacgauggcccaccggaagcccaccuacgagcgcgacguggaccucggcgccggcacccggcacgucgccguggagcccgagguggcgaaccuggacaucaucgggcagcgcaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcgcagaucauggaggucaccgccaaguggcuguggggcuuccugucccgcaacaagaagccccggaucugcacccgcgaggaguucacccggaaggugcgcagcaacgccgccaucggggcgguguucgucgacgagaaccaguggaacuccgccaaggaggccguggaggacgagcgguucugggaccucgugcaccgcgagcgggagcugcacaagcagggcaagugcgccacgugcgucuacaacaugauggggaagcgcgagaagaagcugggcgaguucgggaaggccaagggcagccgggcgaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacccggaucaccgaggacgaccugcagaacgaggcgcgcaucacggacaucauggagccggagcacgcccugcucgccaaguccaucuucaagcugaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcucauccggcagauggagagcgagggcaucuucucccccagcgagcuggagacccccauccuggcggagcgcgugcucgacuggcuggagaaguacggggucgagcggcugaagcgcauggccaucuccggcgacgacugcguggugaagccgaucgacgaccgguucgccaccgcccucacggcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcgcgcgugagccagggcgccggguggagccugcgggagaccgccugccugggcaaguccuacgcccagauguggcagcucauguacuuccaccgccgggaccugcgccuggcggccaacgccaucugcagcgccguccccguggacuggauccccaccucccggaccacguggagcauccacgcccaccaccaguggaugaccaccgaggacaugcucuccguguggaaccgcgucuggaucgaggagaaccccuggauggaggacaagacccacaucagcuccuggggcgacgugccguaccugggcaagcgcgaggaccaguggugcggcagccugaucgggcucacggcgcgggccaccugggccaccaacauccagguggccaucaaccagguccgccggcugaucggcaacgagaacuaccuggacuacaugaccuccaugaagcgcuucaagaacgagagcgaccccgagggggcccucugguga

SEQ ID NO: 8028 - RNA, 9879 nt, Artificial Sequence
  derived and/or modified CDS sequence (opt1) from DENV-1__FJ639686__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagauccgguacgagggcaccgacgcccccugcaagauccccuucagcacccaggacgagcgcggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccggauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcucaagcugcgcgacagcuacacccaggucugcgaccaccggcugauguccgccgccaucaaggacagcaaggccgugcacgccgacaugggcuacuggaucgaguccgagaagaacgagaccuggaagcucgcgcgcgccagcuucaucgaggugaagaccugcaucuggcccaagucccacacgcuguggagcaacggcguccuggaguccgagaugaucauccccaagaucuacgggggcccgaucagccagcacaacuaccggcccggguacuucacccagaccgccggccccuggcaccucgggaagcuggagcuggacuucgaccucugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgcuggucccggaagaugcugaugaccggcacccucgccguguuccugcugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucgggcuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgcuaccucccggccaucguccgggaggccaucaagcgcaagcugcggacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacaccaucgagacgcugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucgggcuccuguucaugauccugacggucgccgcgaacgagaugggccuccuggagaccaccaagaaggaccuggggaucggccacguggccguggggaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggccaaggcgacccgggaggcccagaagcgcaccgccgccgggaucaugaagaaccccaccgucgacggcaucguggccaucgaccuggaccccguggucuacgacgcgaaguucgagaagcagcucggccagaucaugcugcugauccucugcacgucccagauccugcugaugcggaccaccugggcccucugcgagagcaucacccuggccacggggccccugaccacccucugggagggcuccccggggaaguucuggaacaccacgaucgccgugagcauggccaacaucuuccgcggcuccuaccuggcgggcgccgggcuggccuucagccucaugaagucccugggcgggggccggcgcgggaccggcgcccagggcgagacccugggggagaaguggaagcggcagcucaaccagcuguccaagagcgaguucaacaccuacaagcgcuccggcaucauggagguggaccggagcgaggcgaaggaggggcugaagcgcggcgagaucacgaagcacgccgucucccgggggaccgccaagcuccgcugguucguggagcggaaccuggugaagcccgagggcaaggucaucgaccugggcugcgggcgcggcggguggagcuacuacugcgccggccugaagaaggugaccgaggugaagggguacaccaagggcggccccgggcacgaggagcccaucccgauggccacguacggcuggaaccucgucaagcugcacuccgggaaggacguguucuucgugccgcccgagaagugcgacacccugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacgcuggagcagaugcagcgcaagcacggcgggaugcucgugcgcaacccgcugucccggaacagcacccacgagauguacuggguguccugcggcaccgggaacaucgucagcgcggugaacaugaccucccgcaugcugcucaaccgguucaccauggcccaccgcaagcccacguacgagcgggacguggaccugggcgccggcacccgccacgucgccguggagcccgagguggccaaccuggacaucaucgggcagcggaucgagaacaucaagcacgagcacaagagcaccuggcacuacgacgaggacaaccccuacaagaccugggcguaccacggcuccuacgaggucaagccgagcggguccgccagcagcauggugaacggcgucgugaagcuccugacgaagcccugggacgugauccccauggucacccagaucgccaugaccgacaccacgcccuucgggcagcagcgcguguucaaggagaagguggacacccggaccccgaaggccaagcgcggcaccgcccagaucauggaggucacggcgaaguggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgcgacaucagcaagauccccggcggcaacauguacgccgacgacacggccgggugggacacccggaucaccgaggacgaccugcagaacgaggcccgcaucaccgacaucauggagccggagcacgcgcuccuggccaaguccaucuucaagcugacguaccagaacaaggugguccgggugcagcgccccgccaagaacggcaccgugauggacgucaucagccggcgcgaccagcggggguccggccaggugggcaccuacgggcucaacaccuucacgaacauggaggcccagcugauccgccagauggagagcgagggcaucuucucccccagcgagcuggagacccccaaccucgccgagcgggugcuggacuggcuggagaaguacggggucgagcgccucaagcggauggcgaucuccggcgacgacugcguggugaagccgaucgacgaccgcuucgccaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgcgggguggagccugcgcgagacggccugccucggcaaguccuacgcccagauguggcagcugauguacuuccaccggcgcgaccugcgccucgccgcgaacgccaucugcagcgccguccccguggacuggauccccaccucccggaccaccuggagcauccacgcccaccaccaguggaugacgaccgaggacaugcuguccguguggaaccgcgucuggaucgaggagaaccccuggauggaggacaagacccacaucagcuccuggggcgacgugccguaccugggcaagcgggaggaccaguggugcggcagccucaucgggcugaccgcccgcgcgacgugggccaccaacauccagguggccaucaaccagguccggcgccugaucggcaacgagaacuaccucgacuacaugaccuccaugaagcgguucaagaacgagagcgaccccgagggggcccugugguga

SEQ ID NO: 8029 - RNA, 9879 nt, Artificial Sequence
  derived and/or modified CDS sequence (opt1) from DENV-1__FJ639687__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggucaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgccgaggccuucccccaguccaacgccgucauccaggacgaggagcgggacaucccggagcgcagcuggaacuccggguacgaguggaucaccgacuuccccggcaagaccgugugguucgugcccagcaucaaguccggcaacgacaucgcgaacugccugcggaagaacgggaagcgcgucauccagcugagccggaagacguucgacaccgaguaccagaagaccaagaacaacgacugggacuacguggugaccacggacaucuccgagaugggcgccaacuuccgcgccgaccgggucaucgacccccgccggugccucaagccggugauccugaaggacgggcccgagcgcgugauccuggccggccccaugcccgucaccguggccagcgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgcggccaucgacggggaguaccgccugcgcggcgaggcccggaagacguucgucgagcugaugcgccgcggggaccucccgguguggcuguccuacaagguggccagcgagggcuuccaguacuccgaccgccgguggugcuucgacggcgagcgcaacaaccagguccuggaggagaacauggacguggagaucuggaccaaggagggggagcggaagaagcuccgcccccgguggcuggacgcccgcaccuacagcgacccccuggcgcuccgggaguucaaggaguucgccgccggccgccgguccgugagcggggaccugauccuggagaucggcaagcucccccagcaccugacccagcgcgcccagaacgcgcuggacaaccucgucaugcugcacaacuccgagcagggcgggcgggccuaccgccacgccauggaggagcugccggacacgaucgagacccucaugcugcuggcccucaucgccgugcugaccggcggggugacccuguucuuccucagcggccgggggcugggcaagacguccaucggccugcucugcgucauggcgagcuccgugcugcuguggauggccagcguggagccccacuggaucgccgccuccaucauccucgaguucuuccugaugguccugcucauccccgagcccgaccgccagcggaccccgcaggacaaccagcuggccuacguggugaucgggcuccucuucaugauccugaccgucgcggccaacgagaugggccugcucgagaccaccaagaaggaccuggggaucggccacguggccguggagaaccaccaccacgccgccaugcuggacgucgaccuccaccccgcgagcgccuggacgcuguacgccguggccaccaccaucaucacccccaugaugcgccacacgaucgagaacaccaccgccaacaucucccugaccgcgaucgccaaccaggccgccauccucauggggcuggacaagggcuggccgaucagcaagauggacaucggcgugccccugcucgcgcuggggugcuacucccaggucaacccccugacgcucaccgccgccgugcugaugcugguggcccacuacgccaucaucggccccgggcuccaggcgaaggccacccgggaggcccagaagcgcaccgccgccggcaucaugaagaacccgacggucgacgggaucguggcgaucgaccuggaccccguggucuacgacgccaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggcgaacaucuuccggggguccuaccucgccggcgccggccuggccuucagccugaugaagucccucgggggcgggcgccggggcaccggggcgcagggcgagacccugggcgagaaguggaagcgccagcugaaccagcucagcaaguccgaguucaacacguacaagcggagcgggaucauggagguggaccgcuccgaggccaaggagggccugaagcgcggggagaccaccaagcacgccgucagccgcggcaccgccaagcugcggugguucguggagcgcaaccucgugaagccggaggggaaggucaucgaccugggcugcggccgcggcgggugguccuacuacugcgccgggcugaagaaggugacggaggugaagggguacaccaagggcgggcccggccacgaggagcccauccccauggcgaccuacggguggaaccuggucaagcuccacagcggcaaggacguguucuucgugccgcccgagaagugcgacacccugcugugcgacaucggggaguccagccccaaccccacgaucgaggagggccgcacccuccggguccugaagaugguggagccguggcugcgcgggaaccaguucugcaucaagauccucaaccccuacaugcccuccguggucgagacccuggagcagaugcagcggaagcacggcggcaugcuggugcgcaacccccucagccggaacuccacccacgagauguacugggugagcugcgggacgggcaacaucgucuccgccgugaacaugaccagccgcaugcugcugaaccgguucaccauggcccaccgcaagccgaccuacgagcgcgacguggaccucggggccggcacccggcacgucgccguggagcccgagguggcgaaccuggacaucaucggccagcgcaucgagaacaucaagcacgagcacaaguccacguggcacuacgacgaggacaaccccuacaagaccugggccuaccacgggagcuacgaggucaagcccagcggcuccgccagcuccauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcgcagaucauggaggucaccgccaaguggcuguggggcuuccugagccgcaacaagaagccgcggaucugcacccgcgaggaguucacgcggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggcgaucugguacauguggcucggcgcccgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggcgaagaucaccgacaucauggagcccgagcacgcccugcucgccaaguccaucuucaagcugaccuaccagaacaaggugguccgcgugcagcggcccgccaagaacgggaccgugauggacgucaucagccgccgcgaccagcggggcuccggccaggugggcacguacggccugaacaccuucaccaacauggaggcccagcucauccgccagauggagagcgaggggaucuucuccccgagcgagcuggagacccccaaccuggcggagcgggcccucgacuggcuggagaagcacggcguggagcgccugaagcggauggccaucagcggggacgacugcgucgugaagcccaucgacgaccgcuucgccacggcccucaccgcgcugaacgacaugggcaaggugcggaaggacaucccccagugggagccguccaagggguggaacgacuggcagcagguccccuucugcagccaccacuuccaccagcugaucaugaaggacggccgcgagaucguggugcccugccggaaccaggacgagcucgucggccgcgcccgggugucccagggggccggcuggagccugaaggagaccgccugccuggggaaguccuacgcgcagauguggcagcucauguacuuccaccgccgggaccugcgccuggccgccaacgccaucugcagcgccgugcccgucgacugggugccgaccucccggacgaccuggagcauccacgcgcaccaccaguggaugaccaccgaggacaugcucuccguguggaaccgcgucuggaucgaggagaaccccuggauggaggacaagacgcacaucagcuccugggaggacgugcccuaccugggcaagcgggaggaccaguggugcgggagccugaucggccucaccgcccgcgccaccugggccaccaacauccagguggccaucaaccagguccggcgccugaucggcaacgagaacuaccuggacuacaugacguccaugaagcgcuucaagaacgagagcgaccccgagggggcgcucugguga

SEQ ID NO: 8030 - RNA, 9879 nt, Artificial Sequence
  derived and/or modified CDS sequence (opt1) from DENV-1__FJ639688__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgaggccgagcccgacgacguggacugcuggugcaacgccaccgacaccugggugaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccggcaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacgucugggagguggaggacuacggcuucgggaucuucaccacgaacaucuggcugaagcugcgggacagcuacacccaggugugcgaccaccgccucauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccuccgcuuccgcggggaggacggcugcugguacgggauggagauccgccccgugaaggagaaggaggagaaccuggugaaguccauggucagcgccggcagcggcgagguggacuccuucagccucgggcugcugugcaucuccaucaugaucgaggaggugaugcggagccgcuggucccggaagaugcucaugaccggcacccuggccgucuucuuccugcucaucauggggcagcugacguggaacgaccugauccgccucugcaucauggugggcgcgaacgccagcgaccgcauggggaugggcaccaccuaccuggcccugauggccaccuucaagaugcggccgauguucgccgugggccuccuguuccgccggcugacgucccgcgagguccuccugcugaccaucgggcucagccugguggcguccgucgagcugcccaccagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgauggugcugagcaucgugucccuccugccccugugccucagcaccaccucccagaagaccacguggcugcccguccugcucggcagccuggggugcaagccgcugaccauguuccucaucgccgagaacaagaucuggggccggcgcuccuggccccugaacgaggggaucauggccgugggcaucgugagcauccugcucagcucccugcugaagaacgacgucccccucgccgggccccugaucgccggcggcaugcugaucgcgugcuacgugaucagcggguccagcgccgaccucucccuggagaaggccgccgaggugagcugggaggaggaggccgagcacuccggcgcgagccacaacauccuggucgaggugcaggacgacgggaccaugaagaucaaggacgaggagcgggacgacacccucaccauccugcugaaggccacgcuccuggccguguccggcgucuacccgcugagcauccccgccacccucuucgugugguacuucuggcagaagaagaagcagcgcuccggggugcugugggacacccccagcccgcccgaggucgagcgggccgugcuggacgacggcaucuaccgcaucaugcagcggggccugcucgggcgcucccaggugggcgucgggguguuccaggagaacguguuccacaccauguggcacgucacgcggggcgcggugcugauguaccaggggaagcgccuggagcccagcugggccuccgugaagaaggaccucaucagcuacggcggcggguggcggcugcagggcuccuggaacaccggggaggagguccaggugaucgccguggagcccggcaagaaccccaagaacguccagaccgcccccgggaccuucaagacgcccgagggcgaggugggcgccaucgcgcuggacuucaagcccgggaccagcggcucccccaucgugaaccgcgaggggaagaucgucggccucuacggcaacgggguggugaccaccagcggcacguacgucagcgccaucgcccaggccaaggcgucccaggaggggccgcugcccgagaucgaggacgagguguuccggaagcgcaaccugaccaucauggaccuccaccccggcagcgggaagacccggcgcuaccugccggccaucgugcgggaggccaucaagcgcaagcugcgcacccucauccuggcccccacgcgggucguggccuccgagauggcggaggcccugaagggcaugcccauccgcuaccagaccaccgccgucaagagcgagcacaccggcaaggagaucgucgaccucaugugccacgccacguucaccaugcggcugcugucccccgugcgcgugccgaacuacaacaugaucaucauggacgaggcccacuucaccgaccccagcuccaucgcggcccggggguacaucagcacccgcgucggcaugggggaggccgccgccaucuucaugacggcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccgcgccggugccugaagcccgucauccucaaggacgggcccgagcgcgugauccuggccggccccaugccggucaccguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagacguucguggagcugaugcgccgcggggaccugcccgucuggcucuccuacaagguggccagcgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacacgaucgagacccugaugcuccuggcccugaucgccguccucaccggcggggugacccuguucuuccuguccggccgggggcucggcaagaccagcaucggccugcugugcgugauggccuccagcguccuccuguggauggcguccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggccgcgaacgagaugggccugcuggagaccaccaagaaggaccucgggaucggccacgucgccgccgagaaccaccaccacgccgccaugcuggacguggaccugcaccccgcguccgccuggacgcucuacgccguggccaccaccaucaucaccccgaugaugcgccacacgaucgagaacaccaccgccaacaucagccugaccgcgaucgccaaccaggccgccauccugauggggcucgacaagggcuggcccaucuccaagauggacaucggcgucccccugcuggcgcucgggugcuacagccaggugaacccccugacgcugaccgccgccgugcucaugcuggucgcccacuacgccaucaucggcccggggcugcaggcgaaggccacccgcgaggcccagaagcggaccgccgccggcaucaugaagaaccccacgguggacgggaucguggcgaucgaccucgaccccgucguguacgacgccaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgccgugagcauggcgaacaucuuccggggguccuaccuggccggcgccggccucgccuucagccugaugaagucccucgggggcgggcgccgggggaccggggcgcagggcgagacccucggcgagaaguggaagcgccagcugaaccagcuguccaagagcgaguucaacacguacaagcgguccgggaucauggaggucgaccgcagcgaggccaaggagggccucaagcgcggggagaccaccaagcacgccgugucccgcggcaccgccaagcugcggugguucguggagcgcaaccuggucaagcccgaggggaaggugaucgaccugggcugcggccgcgggggcuggagcuacuacugcgccgggcucaagaaggugacggaggucaagggcuacaccaagggcggccccggccacgaggagcccaucccgauggcgaccuacggguggaaccuggugaagcugcacuccggcaaggacguguucuucaucccgcccgagaagugcgacacccuccugugcgacaucggggagagcucccccaacccgacgaucgaggagggccgcacccugcggguccucaagaugguggagcccuggcugcgcgggaaccaguucugcaucaagauccugaaccccuacaugcccagcguggucgagacccucgagcagaugcagcggaagcacggcggcaugcuggugcgcaacccgcugucccggaacagcacccacgagauguacuggguguccugcgggaccggcaacaucgucagcgccgugaacaugacgucccgcaugcuccugaaccgcuucaccauggcccaccggaagcccaccuacgagcgcgacguggaccugggggccggcacccggcacgucgccguggagcccgagguggcgaaccucgacaucaucggccagcgcaucgagaacaucaagcacgagcacaagagcacguggcacuacgacgaggacaaccccuacaagaccugggccuaccacggguccuacgaggucaagccgagcggcuccgccagcagcauggugaacggggucgugaagcugcugaccaagcccugggacgugauccccauggucacccagauggccaugacggacaccacccccuucggccagcagcggguguucaaggagaagguggacacccgcacgccgaaggccaagcgggggaccgcgcagaucauggaggucaccgccaaguggcucuggggcuuccugucccgcaacaagaagccccggaucugcacccgcgaggaguucacgcggaaggugcgcagcaacgccgccaucggcgcgguguucgucgacgagaaccaguggaacuccgccaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaaggggagccgggcgaucugguacauguggcugggcgcccgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacaccgccggcugggacacccggaucacggaggacgaccuccagaacgaggcgcgcaucaccgacaucauggagccggagcacgcccugcuggccaaguccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggcggagcgcgugcuggacuggcucgagaaguacggcgucgagcggcugaagcgcauggccaucuccggggacgacugcguggugaagccgaucgacgaccgguucgccacggcccugaccgcccucaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcuggugggccgggcgcgcgugagccagggggccggcuggagccuccgggagaccgccugccuggggaaguccuacgcccagauguggcagcugauguacuuccaccgccgggaccuccgccuggcggccaacgccaucugcagcgccguccccguggacuggauccccaccucccggacgaccuggagcauccacgcccaccaccaguggaugaccaccgaggacaugcuguccguguggaaccgcgucuggaucgaggagaaccccuggauggaggacaagacgcacaucagcuccuggggcgacgugccguaccucgggaagcgcgaggaccaguggugcggcagccugaucggccugaccgcgcgggccaccugggccaccaacauccagguggccaucuaccagguccgccggcucaucgggaacgagaacuaccuggacuacaugaccuccaugaagcgcuucaagaacgagagcgaccccgagggcgcccugugguga

SEQ ID NO: 8031 - RNA, 9879 nt, Artificial Sequence
  derived and/or modified CDS sequence (opt1) from DENV-1__FJ639689__SS-prME
agcgugaccaugcugcucaugcugaugcccaccgcccuggccuuccaccucaccauccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacccgcacggagaccuggaugagcuccgagggcgccuggaagcagauccagcgggucgagaccugggcccuccgccaccccggguucaccgugaucgcccuguuccuggcgcacgccaucggcacgagcaucacccagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugacgaccauggccaaggacaagcccacccuggacaucgagcuccugaagaccgaggucacgaaccccgcgauccugcggaagcucugcaucgaggccaagaucuccaacaccaccaccgacagccgcugcccgacgcagggcgaggccacccugguggaggagcaggacgccaacuucgugugccggcgcaccuucgucgaccggggcugggggaacggcugcgggcuguucggcaaggggucccucaucacgugcgccaaguucaagugcgugacgaagcuggagggcaagaucgugcaguacgagaaccugaaguacagcgucaucgugaccgugcacaccggcgaccagcaccaggucgggaacgaguccaccgagcacggcacgaccgcgaccaucacgccccaggcccccaccacggagauccagcucaccgacuacggggcccugacccuggacugcagcccccgcaccggccucgacuucaacgagauggugcugcugacgaugaaggagaaguccuggcucguccacaagcagugguuccuggaccugccgcuccccuggaccagcggggccagcaccucccaggagaccuggaaccggcaggaccugcuggugacguucaagaccgcccacgcgaagaagcaggagguggucgugcucggcagccaggagggcgccaugcacaccgcccugaccggggccacggagauccagaccuccggcaccaccacgaucuucgccgggcaccugaagugccgccucaagauggacaagcugacccugaagggcaugagcuacgugaugugcaccggguccuucaagcucgagaaggaggucgcggagacccagcacggcacggugcuggugcagaucaaguacgagggcaccgacgcccccugcaagauccccuucagcacccaggacgagaagggggucacccagaacggccggcugaucacggccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucacgagcguggggaagcugguccaccagaucuucggcaccgccuacggggugcuguucuccggcgugagcuggaccaugaagaucgggaucggcguccugcugaccuggcucggccugaacucccgcagcacguccuucagcaugaccugcaucgccguggggcuggugacccucuaccugggcgucauggugcaggccgacuccgggugcgugaucaacuggaagggccgggagcugaagugcgggagcggcaucuucgucaccaacgaggugcacacguggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacaccacguucaucaucgacgggcccaacaccccggagugccccgacgaccagcgggcguggaacaucugggagguggaggacuacggcuucgggaucuucaccaccaacaucuggcucaagcugcgcgacagcuacacgcaggucugcgaccaccggcugauguccgccgccaucaaggacagcaaggccgugcacgccgacaugggcuacuggaucgaguccgagaagaacgagaccuggaagcucgcgcgcgccagcuucaucgaggugaagaccugcgucuggcccaagucccacacccuguggagcaacggcgugcuggaguccgagaugaucauccccaagaucuacgggggcccgaucagccagcacaacuaccggcccggguacuucacgcagaccgccggccccuggcaccucgggaagcuggagcuggacuucgaccucugcgagggcaccaccguggucguggacgagcacugcggcaaccgcgggccgucccugcggacgaccaccgugaccggcaagaucauccacgaguggugcugccgcagcugcacgcugccgccccuccgguuccgcggggaggacggcugcugguacgggauggagauccggcccgucaaggagaaggaggagaaccuggugaaguccauggugagcgccggcagcggcgaggucgacuccuucagccuggggcuccugugcaucuccaucaugaccgaggaggugaugcgcagccgguggucccgcaagaugcugaugaccggcacccucgccguguuccugcugcucaucauggggcagcugacguggaacgaccugauccgccucugcaucauggucggcgcgaacgccagcgaccggauggggaugggcaccaccuaccuggcccugauggccaccuucaagaugcgcccgauguucgccgugggccuccuguuccggcgccugacgucccgggaggugcuccugcugaccgucgggcucagccugguggcguccgucgagcugcccaacagccucgaggagcugggcgacgggcuggccaugggcaucaugauccucaagcugcugaccgacuuccagccccaccagcucugggccacccugcugucccucacguucaucaagaccaccuucagccugcacuacgccuggaagaccauggcgauggugcuguccaucgugagccucuucccccugugccuguccacgaccagccagaagaccaccuggcucccgguccugcugggcucccucgggugcaagccccugacgauguuccugaucgccgagaacaagaucuggggccgccggagcuggccccucaacgaggggaucauggccgugggcaucguguccauccugcugagcagccuccugaagaacgacgucccccuggccgggccgcucaucgccggcgugaugcugaucgcgugcuacgugaucuccggcagcuccgccgaccugagccucgagaaggccgccgaggucuccugggaggaggaggccgagcacagcggggcgucccacaacauccugguggaggugcaggacgacggcaccaugaagaucaaggacgaggagcgcgacgacacccugaccauccuccugaaggccacccugcucgccgucagcgggguguacccccuguccauccccgccacgcuguucgugugguacuucuggcagaagaagaagcagcggagcggcguccucugggacacccccuccccgcccgagguggagcgcgccgugcuggacgacgggaucuaccggaucaugcagcgcggccugcugggccggagccaggucggggugggcguguuccaggagaacgucuuccacaccauguggcacgugacccgcggggcggugcucauguaccagggcaagcggcuggagcccuccugggccagcgucaagaaggaccugaucuccuacgggggcggcuggcgccuccaggggagcuggaacacgggcgaggagguccaggugaucgccgucgagcccgggaagaacccgaagaacgugcagaccgcccccggcaccuucaagacccccgagggggaggugggcgccaucgcgcuggacuucaagcccggcacguccgggagcccgaucgucaaccgggagggcaagaucguggggcuguacggcaacggcguggucaccaccuccgggaccuacgugagcgccaucgcccaggccaaggcgagccaggagggcccccuccccgagaucgaggacgagguguuccgcaagcggaaccugacgaucauggaccugcacccgggguccggcaagacccgccgguaccuccccgccaucguccgcgaggccaucaagcgcaagcugcggacccugauccucgcccccacccgcgugguggccagcgagauggcggaggcccugaaggggaugcccauccgguaccagacgaccgccgucaaguccgagcacaccggcaaggagaucguggaccugaugugccacgccaccuucacgaugcgccuccugagcccggugcggguccccaacuacaacaugaucaucauggacgaggcccacuucaccgaccccuccagcaucgcggcccgcggcuacaucuccacccggguggggaugggcgaggccgccgccaucuucaugaccgcgacgcccccggggagcguggaggccuucccccaguccaacgccgucauccaggacgaggagcgcgacauccccgagcggagcuggaacuccggcuacgaguggaucaccgacuuccccgggaagaccgugugguucgugccgagcaucaaguccggcaacgacaucgccaacugccugcgcaagaacggcaagcgggucauccagcucagccgcaagaccuucgacacggaguaccagaagaccaagaacaacgacugggacuacguggugaccaccgacaucuccgagaugggggcgaacuuccgggccgaccgcgucaucgacccccggcgcugccugaagcccgugauccugaaggacggccccgagcgggucauccucgccgggccgaugcccgugacgguggccagcgccgcgcagcgccggggccgcaucgggcgcaaccacaacaaggagggcgaccaguacaucuacaugggccagccccugaacaacgacgaggaccacgcccacuggaccgaggccaagaugcugcucgacaacaucaacacccccgaggggaucaucccggcccuguucgagcccgagcgggagaaguccgccgcgaucgacggcgaguaccgccugcgcggggaggcccgcaagaccuucgucgagcucaugcggcgcggcgaccugcccguguggcugagcuacaagguggccuccgagggguuccaguacagcgaccggcgcuggugcuucgacggcgagcggaacaaccagguccucgaggagaacauggacguggagaucuggacgaaggagggcgagcgcaagaagcugcggccccgcuggcuggacgcccggaccuacagcgacccgcucgcccugcgcgaguucaaggaguucgcggccgggcggcgcuccgugagcggcgaccugauccucgagaucgggaagcugccccagcaccugacccagcgggcccagaacgcccucgacaaccuggucaugcugcacaacuccgagcagggcggccgcgcguaccggcacgccauggaggagcuccccgacaccaucgagacgcugaugcugcucgcccugaucgccgugcugaccgggggcgugacccucuucuuccugagcgggcgcggccuggggaagaccuccaucggccuccugugcgucauggccagcuccgugcugcucuggauggcgagcguggagccccacuggaucgccgccuccaucauccuggaguucuuccugaugguccuccugaucccggagcccgaccggcagcgcacgccccaggacaaccagcuggccuacguggugaucggccuccuguucaugauccugacggucgccgcgaacgagauggggcuccuggagaccaccaagaaggaccugggcaucgggcacguggccgugggcaaccaccaccacgccgccaugcucgacgucgaccugcacccggccagcgcguggacccuguacgccguggccacgaccaucaucacccccaugaugcgccacaccaucgagaacacgaccgccaacaucucccucaccgccaucgcgaaccaggccgccauccugauggggcuggacaagggcuggcccaucagcaagauggacaucggcgugccccuccuggcccuggggugcuacucccaggucaacccgcucacccugacggcggccgugcugaugcucguggcccacuacgccaucaucggccccgggcugcaggccaaggcgacccgggaggcccagaagcgcaccgccgccggcaucaugaagaaccccaccgucgacgggaucguggccaucgaccuggaccccguggucuacgacgcgaaguucgagaagcagcucggccagaucaugcugcugauccucugcacgagccagauccugcugaugcggaccaccugggcccucugcgaguccaucacccuggccacgggcccgcugaccacccucugggaggggagccccggcaaguucuggaacaccacgaucgccguguccauggccaacaucuuccgcgggagcuaccuggcgggcgccggccuggccuucucccucaugaagucccucgggggcgggcggcgcgggaccggggcccagggcgagacccugggcgagaaguggaagcggcagcucaaccagcugagcaaguccgaguucaacaccuacaagcgcagcgggaucauggagguggaccgguccgaggcgaaggagggccugaagcgcggggagaucacgaagcacgccgucagccggggcaccgccaagcuccgcugguucguggagcggaaccuggugaagcccgaggggaaggucaucgaccugggcugcggccgcgggggcugguccuacuacugcgccgggcugaagaaggugaccgaggugaagggcuacaccaagggcgggcccggccacgaggagccgauccccauggccacguacggguggaaccucgucaagcugcacagcggcaaggacguguucuucgugccgcccgagaagugcgacacccugcucugcgacaucggggaguccagcccgaaccccaccaucgaggagggccggacccugcgcguccugaagaugguggagcccuggcuccgggggaaccaguucugcaucaagauccugaaccccuacaugccguccguggucgagacgcuggagcagaugcagcgcaagcacggcggcaugcucgugcggaacccccugagccgcaacuccacccacgagauguacugggugagcugcgggaccggcaacaucgucuccgcggugaacaugaccagccgcaugcugcucaaccgguucaccauggcccaccgcaagcccacguacgagcgggacguggaccugggggccggcacccgccacgucgccguggagcccgaggucgccaaccuggacaucaucggccagcggaucgagaacaucaagcacgagcacaaguccaccuggcacuacgacgaggacaacccguacaagaccugggcguaccacgggagcuacgaggugaagcccuccggcagcgccuccagcauggugaacggggucgugaagcuccugacgaagcccugggacgugauccccauggucacccagaucgccaugaccgacaccacgccguucggccagcagcgcguguucaaggagaagguggacacccggacccccaaggccaagcgcgggaccgcccagaucauggaggucacggcgaaguggcuguggggcuuccucagccggaacaagaagccccgcaucugcacccgggaggaguucacccgcaaggugcgguccaacgccgccaucggcgccguguucgucgacgagaaccaguggaacagcgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccggcgggaacauguacgccgacgacacggccgggugggacacccgcaucaccgaggacgaccugcagaacgaggcccgcaucaccgacaucauggagcccgagcacgcgcuccuggccaagagcaucuucaagcugacguaccagaacaaggugguccgggugcagcgccccgccaagaacgggaccgugauggacgucaucucccggcgcgaccagcggggcagcggccaggugggcaccuacggccucaacaccuucacgaacauggaggcccagcugauccgccagauggaguccgaggggaucuucagccccuccgagcuggagaccccgaaccucgccgagcgggugcuggacuggcuggagaaguacggcgucgagcgccucaagcggauggcgaucagcggggacgacugcguggugaagcccaucgacgaccgcuucgccaccgcccugaccgcccugaacgacaugggcaagguccggaaggacaucccccagugggagcccuccaagggguggaacgacuggcagcaggucccguucugcagccaccacuuccaccagcucaucaugaaggacggccgcgagaucgugguccccugccggaaccaggacgagcuggugggccgcgcccgggugucccagggggcgggcuggagccugcgcgagacggccugccucggcaagagcuacgcccagauguggcagcugauguacuuccaccggcgcgaccugcggcucgccgcgaacgccaucugcuccgccguccccguggacuggauccccaccagccgcaccaccugguccauccacgcccaccaccaguggaugacgaccgaggacaugcugagcguguggaaccgcgucuggaucgaggagaacccguggauggaggacaagacccacaucuccagcuggggcgacgugcccuaccuggggaagcgggaggaccaguggugcggcucccucaucggccugaccgcccgcgcgacgugggccaccaacauccagguggccaucaaccagguccggcgccugaucgggaacgagaacuaccucgacuacaugaccagcaugaagcgguucaagaacgaguccgaccccgagggcgcccugugguga

SEQ ID NO: 8032 - RNA, 9879 nt, Artificial Sequence
  derived and/or modified CDS sequence (opt1) from DENV-1__FJ639690__SS-prME
agcgugaccaugcugcucaugcugaugcccaccgcccuggccuuccaccucaccauccgcggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccgcaucaccgaggccgagcccgacgacguggacugcuggugcaacgccaccgacaccugggucaccuacgggaccugcagccagaucggcgagcaccggcgcgacaagcgguccguggcccucgcgccccacgugggccuggggcuggagacccgcaccgagaccuggaugagcuccgagggcgccuggaagcagauccagcgggucgagaccugggcccuccgccaccccggguucaccgugaucgcccuguuccuggcgcacgccaucggcaccagcaucacgcagaaggggaucaucuucauccuccugaugcuggugacccccuccauggccaugcggugcgucggcaucggcagccgcgacuucguggaggggcucuccggcgccaccuggguggacgucgugcuggagcacgggagcugcgugaccacgauggccaaggacaagcccacccuggacaucgagcuccugaagaccgaggucaccaaccccgcgauccugcggaagcucugcaucgaggccaagaucuccaacacgaccaccgacagccgcugcccgacccagggcgaggccacgcugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugacggugcacaccggcgaccagcaccaggucgggaacgaguccaccgagcacggcaccacggcgaccaucacgccccaggcccccaccaccgagauccagcucacggacuacggggcccugacccuggacugcagcccccgcaccggccucgacuucaacgagauggugcugcugaccaugaaggagaaguccuggcucguccacaagcagugguuccuggaccugccgcuccccuggacgagcggggccagcaccucccaggagaccuggaaccggcaggaccugcuggugaccuucaagacggcccacgcgaagaagcaggagguggucgugcucggcagccaggagggcgccaugcacaccgcccugaccggggccaccgagauccagacguccggcaccaccaccaucuucgccgggcaccugaagugccgccucaagauggacaagcugacgcugaagggcaugagcuacgugaugugcaccggguccuucaagcucgagaaggaggucgcggagacccagcacggcaccgugcuggugcagaucaaguacgagggcacggacgcccccugcaagauccccuucagcacccaggacgagaagggggucacccagaacggccggcugaucaccgccaacccgaucgugacggacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucaccagcguggggaagcugguccaccagaucuucggcacggccuacgggguccucuucuccggcgugagcuggaccaugaagaucgggaucggcguccugcugaccuggcucggccugaacucccgcagcaccuccuucagcaugacgugcaucgccguggggcuggugacccucuaccugggcgucauggugcaggccgacuccgggugcgugaucaacuggaagggccgggagcugaagugcgggagcggcaucuucgucaccaacgaggugcacaccuggacggagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacaccaccuucaucaucgacgggcccaacacgccggagugccccgacgaccagcgggcguggaacaucugggagguggaggacuacggcuucgggaucuucaccaccaacaucuggcucaagcugcgcgacagcuacacccaggucugcgaccaccggcugauguccgccgccaucaaggacagcaaggccgugcacgccgacaugggcuacuggaucgaguccgagaagaacgagacguggaagcucgcgcgcgccagcuucaucgaggugaagaccugcgucuggcccaagucccacacccuguggagcaacggcgugcuggaguccgagaugaucauccccaagaucuacgggggcccgaucagccagcacaacuaccggcccggguacuucacccagacggccggccccuggcaccucgggaagcuggagcuggacuucgaccucugcgagggcaccaccguggucguggacgagcacugcggcaaccgcgggccgucccugcggaccacgaccgugaccggcaagaucauccacgaguggugcugccgcagcugcacccugccgccccuccgguuccgcggggaggacggcugcugguacgggauggagauccggcccgucaaggagaaggaggagaaccuggugaaguccauggugagcgccggcagcggcgaggucgacuccuucagccuggggcuccugugcaucuccaucaugacggaggaggugaugcgcagccgguggucccgcaagaugcugaugaccggcacccucgccguguuccugcugcucaucauggggcagcugaccuggaacgaccugauccgccucugcaucauggucggcgcgaacgccagcgaccggauggggaugggcacgaccuaccuggcccugauggccaccuucaagaugcgcccgauguucgccguggggcuccuguuccggcgccugaccucccgggaggugcuccugcugacggucgggcucagccugguggcguccgucgagcugcccaacagccucgaggagcugggcgacgggcuggccaugggcaucaugauccucaagcugcugaccgacuuccagccccaccagcucugggccacccugcugucccucaccuucaucaagacgaccuucagccugcacuacgccuggaagaccauggcgauggugcuguccaucgugagccucuucccccugugccuguccaccacgagccagaagaccaccuggcucccgguccugcugggcucccucgggugcaagccccugaccauguuccugaucgccgagaacaagaucuggggccgccggagcuggccccucaacgaggggaucauggccgugggcaucguguccauccugcugagcagccuccugaagaacgacgucccccuggccgggccgcucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggacgaugaagaucaaggacgaggagcgcgacgacacccugaccauccuccugaaggccacccugcucgccgugagcggcgucuacccccuguccauccccgccacccuguucgugugguacuucuggcagaagaagaagcagcggagcggggugcucugggacacgcccuccccgcccgaggucgagcgcgccgugcuggacgacggcaucuaccggaucaugcagcgcggccugcuggggcggagccaggugggcgucgggguguuccaggagaacguguuccacaccauguggcacgucacccgcggcgcggugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaacccgaagaacguccagacggcccccgggaccuucaagacccccgagggcgaggugggcgccaucgcgcuggacuucaagcccgggaccuccggcagcccgaucgugaaccgggaggggaagaucgucggccuguacggcaacgggguggugacgaccuccggcaccuacgucagcgccaucgcccaggccaaggcgagccaggaggggccccuccccgagaucgaggacgagguguuccgcaagcggaaccugaccaucauggaccugcacccgggcuccgggaagacgcgccgguaccuccccgccaucgugcgcgaggccaucaagcgcaagcugcggacccugauccucgcccccacccgcgucguggccagcgagauggcggaggcccugaagggcaugcccauccgguaccagaccacggccgugaaguccgagcacaccggcaaggagaucgucgaccugaugugccacgccaccuucaccaugcgccuccugagcccggugcgggugcccaacuacaacaugaucaucauggacgaggcccacuucacggaccccuccagcaucgcggcccgcggguacaucuccacccgggucggcaugggggaggccgccgccaucuucaugaccgcgacgccgcccggcagcguggaggccuucccccaguccaacgccgugauccaggacgaggagcgcgacauccccgagcggagcuggaacuccggguacgaguggaucacggacuuccccggcaagaccgucugguucgugcccagcaucaaguccggcaacgacaucgccaacugccugcgcaagaacgggaagcgggugauccagcucagccgcaagaccuucgacaccgaguaccagaagacgaagaacaacgacugggacuacgucgugaccaccgacaucuccgagaugggcgcgaacuuccgggccgaccgcgugaucgacccccggcgcugccugaagcccgucauccugaaggacgggcccgagcgggugauccucgccggcccgaugcccgucaccguggccagcgccgcgcagcgccgggggcgcaucggccgcaaccacaacaaggagggcgaccaguacaucuacauggggcagccccugaacaacgacgaggaccacgcccacuggacggaggccaagaugcugcucgacaacaucaacacccccgagggcaucaucccggcccuguucgagcccgagcgggagaaguccgccgcgaucgacggggaguaccgccugcggggcgaggcccgcaagaccuucguggagcucaugcggcgcggggaccugcccgucuggcugagcuacaagguggccuccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacagcgacccgcucgcccugcgcgaguucaaggaguucgcggccggccggcgcuccgugagcggggaccugauccucgagaucggcaagcugccccagcaccugacccagcgggcccagaacgcccucgacaaccuggugaugcugcacaacuccgagcagggcgggcgcgcguaccggcacgccauggaggagcuccccgacaccaucgagacccugaugcugcucgcccugaucgccguccugacgggcggggugacccucuucuuccugagcggccgcgggcugggcaagaccuccaucggccuccugugcgugauggccagcuccguccugcucuggauggcgagcguggagccccacuggaucgccgccuccaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagacgaccaagaaggaccuggggaucggccacgucgccguggggaaccaccaccacgccgccaugcucgacguggaccugcacccggccagcgcguggacccuguacgccgucgccaccacgaucaucacccccaugaugcgccacaccaucgagaacaccacggccaacaucucccucaccgccaucgcgaaccaggccgccauccugaugggccuggacaagggcuggcccaucagcaagauggacaucggggugccccuccuggcccugggcugcuacucccaggugaacccgcucacccugaccgcggccguccugaugcucguggcccacuacgccaucaucgggcccggccugcaggccaaggcgacgcgggaggcccagaagcgcaccgccgccgggaucaugaagaaccccaccguggacggcaucgucgccaucgaccuggaccccgugguguacgacgcgaaguucgagaagcagcucggccagaucaugcugcugauccucugcaccagccagauccugcugaugcggacgaccugggcccucugcgaguccaucacccuggccaccgggccgcugacgacccucugggagggcagccccgggaaguucuggaacaccaccaucgccgucuccauggccaacaucuuccgcggcagcuaccuggcgggcgccgggcuggccuucucccucaugaagucccugggcgggggccggcgcgggacgggcgcccagggcgagacccugggggagaaguggaagcggcagcucaaccagcugagcaaguccgaguucaacaccuacaagcgcagcggcaucauggagguggaccgguccgaggcgaaggaggggcugaagcgcggcgagaucaccaagcacgccgugagccgggggacggccaagcuccgcugguucgucgagcggaaccuggugaagcccgagggcaaggugaucgaccugggcugcgggcgcggcgggugguccuacuacugcgccggccugaagaaggucaccgaggugaagggguacaccaagggcggccccgggcacgaggagccgauccccauggccaccuacggcuggaaccucgugaagcugcacagcgggaaggacgucuucuucgugccgcccgagaagugcgacacgcugcucugcgacaucggcgaguccagcccgaaccccaccaucgaggaggggcggacccugcgcgugcugaagauggucgagcccuggcuccggggcaaccaguucugcaucaagauccugaaccccuacaugccguccgugguggagacccuggagcagaugcagcgcaagcacggcgggaugcucguccggaacccccugagccgcaacuccacgcacgagauguacugggugagcugcggcaccgggaacaucguguccgcggucaacaugaccagccgcaugcugcucaaccgguucaccauggcccaccgcaagcccaccuacgagcgggacguggaccugggcgccggcacgcgccacguggccgucgagcccgagguggccaaccuggacaucaucgggcagcggaucgagaacaucaagcacgagcacaaguccaccuggcacuacgacgaggacaacccguacaagaccugggcguaccacggcagcuacgaggucaagcccuccgggagcgccuccagcauggugaacggcguggucaagcuccugaccaagcccugggacgugauccccauggugacgcagaucgccaugaccgacaccaccccguucgggcagcagcgcgucuucaaggagaagguggacacgcggacccccaaggccaagcgcggcaccgcccagaucauggaggugaccgcgaaguggcuguggggcuuccucagccggaacaagaagccccgcaucugcacgcgggaggaguucacccgcaagguccgguccaacgccgccaucggggccguguucguggacgagaaccaguggaacagcgcgaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcucccgcgccaucugguacauguggcugggcgcgcgguuccuggaguucgaggcccucggguucaugaacgaggaccacugguucagccgcgagaacucccugagcggcgucgagggggagggccugcacaagcucggguacauccugcgggacaucuccaagaucccgggcggcaacauguacgccgacgacaccgccgggugggacacgcgcaucaccgaggacgaccugcagaacgaggcccgcaucaccgacaucauggagcccgagcacgcgcuccuggccaagagcaucuucaagcugaccuaccagaacaagguggugcggguccagcgccccgccaagaacggcacggugauggacgugaucucccggcgcgaccagcgggggagcggccaggucggcaccuacgggcucaacaccuucaccaacauggaggcccagcugauccgccagauggaguccgagggcaucuucagccccuccgagcuggagacgccgaaccucgccgagcgggugcuggacuggcuggagaaguacgggguggagcgccucaagcggauggcgaucagcggcgacgacugcgucgugaagcccaucgacgaccgcuucgccaccgcccugaccgcccugaacgacauggggaaggugcggaaggacaucccccagugggagcccuccaagggcuggaacgacuggcagcaggucccguucugcagccaccacuuccaccagcucaucaugaaggacggccgcgagaucguggugcccugccggaaccaggacgagcuggucgggcgcgcccgggugucccagggcgcgggguggagccugcgcgagaccgccugccucggcaagagcuacgcccagauguggcagcugauguacuuccaccggcgcgaccugcggcucgccgcgaacgccaucugcuccgccgugcccgucgacuggauccccacgagccgcaccaccugguccauccacgcccaccaccaguggaugaccacggaggacaugcugagcguguggaaccgcguguggaucgaggagaacccguggauggaggacaagacccacaucuccagcuggggcgacguccccuaccugggcaagcgggaggaccaguggugcggcucccucaucgggcugaccgcccgcgcgaccugggccacgaacauccagguggccaucaaccaggugcggcgccugaucggcaacgagaacuaccucgacuacaugaccagcaugaagcgguucaagaacgaguccgaccccgagggggcccugugguga

SEQ ID NO: 8033 - RNA, 9879 nt, Artificial Sequence
  derived and/or modified CDS sequence (opt1) from DENV-1__FJ639691__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccaguccuaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgcgaacuuccgcgccgaccgggugaucgacccccgccggugccucaagccggugauccugaaggacgggcccgagcgcgucauccuggccggccccaugcccgugaccgucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccgugcugaccggcggggucacccuguucuuccucagcggccgggggcugggcaagacguccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccagcgcguggacgcuguacgccguggccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgucccccugcucgcccuggggugcuacucccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggcgaaggagggccugaagcgcggggagaccaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugacggaggucaagggguacaccaagggcgggcccggccacgaggagcccauccccauggccaccuacggguggaaccuggugaagcuccacagcggcaaggacguguucuucgucccgcccgagaagugcgacacccugcugugcgacaucggggaguccagccccaaccccacgaucgaggagggccgcacccuccgggugcugaagaugguggagccguggcugcgcgggaaccaguucugcaucaagauccucaaccccuacaugcccuccgucguggagacccuggagcagaugcagcggaagcacggcggcaugcuggugcgcaacccccucagccggaacuccacccacgagauguacugggucagcugcgggacgggcaacaucguguccgcggugaacaugaccagccgcaugcugcugaaccgguucaccauggcccaccgcaagccgaccuacgagcgcgacgucgaccucggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagcccagcggcuccgccagcuccauggucaacgggguggugaagcugcucaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccugagccgcaacaagaagccgcggaucugcacccgcgaggaguucacgcggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggucgugcgcgugcagcggcccgccaagaacgggaccgucauggacgugaucagccgccgcgaccagcggggcuccggccaggugggcacguacggccugaacaccuucaccaacauggaggcccagcucauccgccagauggagagcgaggggaucuucuccccgagcgagcuggagacccccaaccuggccgagcggacgcucgacuggcuggagaagcacggcgucgagcgccugaagcggauggcgaucagcggggacgacugcguggugaagcccaucgacgaccgcuucgccaccgcccucaccgcccugaacgacaugggcaagguccggaaggacaucccccagugggagccguccaagggguggaacgacuggcagcagguccccuucugcagccaccacuuccaccagcugaucaugaaggacggccgcgagaucgugguccccugccggaaccaggacgagcucgugggccgcgcccgggugucccagggggcgggcuggagccugcgcgagaccgccugccuggggaaguccuacgcccagauguggcagcucauguacuuccaccggcgcgaccugcggcuggccgcgaacgccaucugcagcgccguccccguggacugggugccgacgucccgcaccaccuggagcauccacgcccaccaccaguggaugaccacggaggacaugcucuccgucuggaaccggguguggaucgaggagaaccccuggauggaggacaagacccacaucagcuccugggaggacgugcccuaccugggcaagcgcgaggaccaguggugcgggagccugaucggccucaccgcccgggcgaccugggccacgaacauccaggucgccaucaaccaggugcgccgccugaucggcaacgagaacuaccuggacuacaugaccuccaugaagcgguucaagaacgagagcgaccucgagggggcccugugguga

SEQ ID NO: 8034 - RNA, 9879 nt, Artificial Sequence
  derived and/or modified CDS sequence (opt1) from DENV-1__FJ639692__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagagcgccuggaagcagauccagcggguggagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugcccgacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccccuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuucuccacccaggacgagaagggcgucacgcagaacgggcggcugaucaccgccaacccgaucgugaccgacaaggagaagcccgugaacaucgaggccgagccgcccuucggcgagagcuacaucgucaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgugggcaagcugguccaccagaucuucgggaccgccuacggcguccuguucagcgggguguccuggaccaugaagaucggcaucgggguccugcugacguggcucggccugaacagccgcuccaccagccuguccaugaccugcaucgccgugggccucgugacccuguaccugggggucauggugcaggccgacagcggcugcgugaucaacuggaaggggcgggagcucaagugcggcagcgggaucuucgucacgaacgaggugcacaccuggaccgagcaguacaaguuccaggcggacuccccgaagcgccugagcgccgccaucggcaaggccugggaggagggcgugugcgggauccgguccgccacccgccuggagaacaucauguggaagcagaucagcaacgagcucaaccacauccugcuggagaacgacaugaaguucaccgucguggugggcgacgucgcggggauccucgcccagggcaagaagaugauccggccccagcccauggaguacaaguacuccuggaaguccugggggaaggccaagaucaucggcgccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacuccuacacccaggucugcgaccaccgccucaugagcgccgccaucaaggacuccaaggccgugcacgccgacaugggguacuggaucgagagcgagaagaacgagaccuggaagcuggcgcgggccuccuucaucgaggugaagaccugcaucuggcccaagagccacacgcugugguccaacggcguccucgagagcgagaugaucauccccaagaucuacggcgggccgaucucccagcacaacuaccgccccggcuacuucacccagaccgccgggcccuggcaccugggcaagcuggagcucgacuucgaccugugcgaggggaccacggugguggucgacgagcacugcggcaaccggggcccgagccugcgcaccaccaccgugacggggaagaucauccacgaguggugcugccgguccugcacccugccgccccuccgcuuccggggcgaggacgggugcugguacggcauggagauccgccccgugaaggagaaggaggagaaccuggucaagagcauggugagcgccggguccggcgagguggacagcuucucccucggccugcugugcaucagcaucaugaucgaggaggucaugcggucccgcuggagccggaagaugcucaugaccgggacccuggccguguuccugcuccugaucaugggccagcugacguggaacgaccucauccgccugugcaucauggugggggcgaacgccuccgaccgcaugggcauggggaccaccuaccuggcccucauggccaccuucaagaugcggccgauguucgccgucgggcugcuguuccgccggcucacgagccgcgaggugcugcugcucaccaucggccugucccugguggcgagcgucgagcuccccaacucccuggaggagcugggggacggccucgccauggggaucaugauccugaagcugcucaccgacuuccagagccaccagcugugggccacccugcucucccugacguucaucaagaccaccuucagccugcacuacgccuggaagaccauggcgauggugcucuccaucgucagccuguucccccugugccucuccacgaccagccagaagaccaccuggcugcccgugcugcucggcucccugggcugcaagccgcugacgauguuccucaucgccgagaacaagaucugggggcggcgcagcuggccccugaacgagggcaucauggccguggggaucgucagcauccugcucuccagccugcugaagaacgacgugccccucgccggcccccugaucgccgggggcaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgggacgacacccucaccauccugcugaaggccacccuccuggccgucagcgggguguacccgcuguccauccccgccacccucuucgugugguacuucuggcagaagaagaagcagcgcagcggcguccugugggacacccccagcccgcccgagguggagcgggccgugcuggacgacgggaucuaccgcaucaugcagcggggccugcucggccgcagccaggucggggugggcguguuccaggagaacgucuuccacaccauguggcacgugacccgcggggccgugcugauguaccagggcaagcgccuggagcccuccugggccagcgucaagaaggaccucaucuccuacgggggcggcuggcggcugcaggggagcuggaacacgggcgaggagguccaggugaucgccgucgagcccgggaagaaccccaagaacgugcagaccgcccccggcaccuucaagacccccgagggggaggugggcgccaucgcgcuggacuucaagcccggcacguccgggagccccaucgucaaccgcgagggcaagaucguggggcucuacggcaacggcguggucaccaccagcgggaccuacguguccgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaaggggaugcccauccgcuaccagacgaccgccgucaaguccgagcacaccggcaaggagaucguggaccucaugugccacgccaccuucacgaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugaccgcgacgccgcccgggagcguggaggccuucccgcaguccaacgcccucauccaggacgaggagcgggacauccccgagcgcagcuggaacuccggcuacgaguggaucaccgacuuccccgggaagaccgucugguucgugcccagcaucaaguccggcaacgacaucgccaacugccugcggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccgcgccggugccucaagcccgucauccugaaggacggccccgagcgcgugauccuggccgggcccaugccggugacggucgccagcgccgcgcagcggcgcggccggaucgggcgcaaccacaacaaggagggcgaccaguacaucuacaugggccagccccucaacaacgacgaggaccacgcccacuggaccgaggccaagaugcugcuggacaacaucaacacccccgaggggaucauccccgcccucuucgagccggagcgcgagaaguccgccgcgaucgacggcgaguaccggcugcgcggggaggcccggaagaccuucguggagcugaugcgccggggcgaccuccccgucuggcugagcuacaagguggccagcgagggguuccaguacuccgaccgccgguggugcuucgacggcgagcgcaacaaccaggugcuggaggagaacauggacgucgagaucuggacgaaggagggcgagcggaagaagcuccgcccccgguggcuggacgcccgcaccuacagcgacccccuggcccuccgggaguucaaggaguucgcggccgggcgccgguccgugagcggcgaccugauccuggagaucgggaagcucccgcagcaccugacccagcgcgcccagaacgcccuggacaaccucgugaugcugcacaacuccgagcagggcggccgggcguaccgccacgccauggaggagcugcccgacaccaucgagacgcucaugcugcuggcccucaucgccguccugaccgggggcgugacccuguucuuccucagcgggcggggccuggggaagaccuccaucggccugcucugcgugauggccagcuccguccugcuguggauggcgagcguggagccccacuggaucgccgccuccaucauccucgaguucuuccugauggugcugcucauccccgagccggaccgccagcggacgccccaggacaaccagcuggccuacgucgugaucggccuccucuucaugauccugacgguggccgcgaacgagauggggcugcucgagaccaccaagaaggaccugggcaucgggcacgucgccgugggcaaccaccaccacgccgccaugcuggacguggaccuccaccccgccagcgcguggacccuguacgccgucgccacgaccaucaucaccccgaugaugcgccacaccaucgagaacacgaccgccaacaucucccugaccgccaucgcgaaccaggccgccauccucauggggcuggacaagggcuggcccaucagcaagauggacaucggcgugccccugcucgcccuggggugcuacucccaggugaacccccugacccucacggcggccguccugaugcugguggcccacuacgccaucaucggcccggggcuccaggccaaggcgacccgcgaggcccagaagcggaccgccgccggcaucaugaagaaccccaccguggacgggaucgucgccaucgaccuggaccccgugguguacgacgcgaaguucgagaagcagcugggccagaucaugcuccugauccugugcacgagccagauccuccugaugcgcaccaccugggcccugugcgaguccaucacccucgccacgggcccccugaccacccugugggaggggagcccgggcaaguucuggaacaccacgaucgccgucuccauggccaacaucuuccgggggagcuaccucgcgggcgccggccuggccuucagccugaugaagucccucgggggcgggcgccggggcaccggggcccagggcgagacccugggcgagaaguggaagcgccagcugaaccagcucagcaaguccgaguucaacaccuacaagcggagcgggaucacggagguggaccgcuccgaggcgaaggagggccugaagcgcggggagaccaccaagcacgccgugagccgcggcaccgccaagcugcggugguucgucgagcgcaaccuggugaagcccgaggggaaggugaucgaccucggcugcggccgcggcgggugguccuacuacugcgccgggcugaagaaggucacggaggugaagggguacaccaagggcgggcccggccacgaggagcccaucccgauggccaccuacggguggaaccuggugaagcuccacagcggcaaggacgucuucuucaucccgcccgagaagugcgacacccugcugugcgacaucggggaguccagccccaacccgacgaucgaggagggccgcacccuccgggugcugaagaugguggagcccuggcugcgcgggaaccaguucugcaucaagauccucaaccccuacaugcccuccgucguggagacccuggagcagaugcagcggaagcacggcggcaugcuggugcgcaacccgcucagccggaacuccacccacgagauguacugggucagcugcgggaccggcaacaucguguccgcggugaacaugacgagccgcaugcugcugaaccgcuucaccauggcccaccggaagcccaccuacgagcgcgacgucgaccucggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagccguccggcagcgccagcuccauggugaacggggucgugaagcugcucaccaagcccugggacgucauccccauggugacccagaucgccaugacggacaccacccccuucggccagcagcggguguucaaggagaaggucgacacccgcacgccgaaggccaagcgggggaccgcccagaucauggaggugaccgcgaaguggcuguggggcuuccugagccgcaacaagaagccccggaucugcacccgcgaggaguucacgcggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagauccccgggggcaacauguacgccgacgacaccgccggcugggacacccggaucacggaggacgaccugcagaacgaggcccgcaucaccgacaucauggagccggagcacgcgcugcucgccaagagcaucuucaagcugaccuaccagaacaaggucgugcgcgugcagcggcccgccaagaacgggaccgucauggacgugaucucccgccgggaccagcgcggcagcggccaggugggcacguacggccugaacaccuucaccaacauggaggcccagcucauccggcagauggaguccgaggggaucuucagccccuccgagcuggagacccccaaccuggccgagcgcguccucgacuggcuggagaaguacggcguggagcggcugaagcgcauggcgaucagcggggacgacugcguggucaagccgaucgacgaccgguucgccacggcccucaccgcccugaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcucgugggccgggcccgcgucagccagggggcgggcuggucccugcgggagaccgccugccugggcaagagcuacgcccagauguggcagcucauguacuuccaccgccgggaccugcgccuggccgcgaacgccaucugcuccgccgugcccguggacuggauccccaccagccggacgaccugguccauccacgcccaccaccaguggaugaccaccgaggacaugcucagcgucuggaaccgcguguggaucgaggagaaccccuggauggaggacaagacgcacaucuccagcuggggcgacgugccguaccuggggaagcgcgaggaccaguggugcggcucccugaucggccucaccgcccgggcgaccugggccaccaacauccaggucgccaucaaccaggugcgccggcugaucgggaacgagaacuaccuggacuacaugaccagcaugaagcgcuucaagaacgaguccgaccccgagggcgcccucugguga

SEQ ID NO: 8035 - RNA, 9879 nt, Artificial Sequence
  derived and/or modified CDS sequence (opt1) from DENV-1__FJ639693__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgaguucugcgaggacaccaugaccuacaagugcccccggaucagcgaggccgagcccgacgacguggacugcuggugcaacgccaccgacaccugggucaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccacccgggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgccgaggccuucccccaguccaacgccgucauccaggacgaggagcgggacaucccggagcgcagcuggaacuccggguacgaguggaucaccgacuuccccggcaagaccgugugguucgugcccagcaucaaguccggcaacgacaucgcgaacugccugcggaagaacgggaagcgcgucauccagcugagccggaagacguucgacaccgaguaccagaagaccaagaacaacgacugggacuacguggugaccacggacaucuccgagaugggcgccaacuuccgcgccgaccgggucaucgacccccgccggugccucaagccggugauccugaaggacgggcccgagcgcgugauccuggccggccccaugcccgucaccguggccagcgcggcccagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgcggccaucgacggggaguaccgccugcgcggcgaggcccggaagacguucgucgagcugaugcgccgcggggaccucccgguguggcuguccuacaagguggccagcgagggcuuccaguacuccgaccgccgguggugcuucgacggcgagcgcaacaaccagguccuggaggagaacauggacguggagaucuggaccaaggagggggagcggaagaagcuccgcccccgguggcuggacgcccgcaccuacagcgacccccuggcgcuccgggaguucaaggaguucgccgccggccgccgguccgugagcggggaccugauccuggagaucggcaagcucccccagcaccugacccagcgcgcccagaacgcgcuggacaaccucgucaugcugcacaacuccgagcagggcgggcgggccuaccgccacgccauggaggagcugccggacacgaucgagacccucaugcugcuggcccucaucgccgugcugaccggcggggugacccuguucuuccucagcggccgggggcugggcaagacguccaucggccugcucugcgucauggcgagcuccgugcugcuguggauggccagcguggagccccacuggaucgccgccuccaucauccucgaguucuuccugaugguccugcucauccccgagcccgaccgccagcggaccccgcaggacaaccagcuggccuacguggugaucgggcuccuguucaugauccugaccgucgcggccaacgagaugggccugcucgagaccaccaagaaggaccuggggaucggccacguggccguggagaaccaccaccacgccgccaugcuggacgucgaccuccaccccgcgagcgccuggacgcuguacgccguggccaccaccaucaucacccccaugaugcgccacacgaucgagaacaccaccgccaacaucucccugaccgcgaucgccaaccaggccgccauccucauggggcuggacaagggcuggccgaucagcaagauggacaucggcgugccccugcucgcgcuggggugcuacucccaggucaacccccugacgcucaccgccgccgugcugaugcugguggcccacuacgccaucaucggccccgggcuccaggcgaaggccacccgggaggcccagaagcgcaccgccgccggcaucaugaagaacccgacggucgacgggaucguggcgaucgaccuggaccccguggucuacgacgccaaguucgagaagcagcugggccagaucaugcuccugauccugugcaccagccagauccuccugaugcgcaccaccugggcccugugcgaguccaucacgcucgccgugggcuuccagaccacccugugggaggggagccccggcaaguucuggaacaccacgaucgccgugagcauggcgaacaucuuccggggguccuaccuggccggcgccggccucgccuucagccugaugaagucccucgggggcgggcgccgggggaccggggcgcagggcgagacccucggcgagaaguggaagcgccagcugaaccagcugagcaaguccgaguucaacaccuacaagcggagcgggaucauggaggucgaccgcuccgaggccaaggagggccucaagcgcggggagacgaccaagcacgccgugagccgcggcaccgccaagcugcggugguucguggagcgcaaccuggucaagcccgaggggaaggugaucgaccucggcugcggccgcggcgggugguccuacuacugcgccgggcugaagaaggugaccgaggucaagggguacacgaagggcggcccgggccacgaggagcccauccccauggcgaccuacggguggaaccuggugaagcugcacagcggcaaggacguguucuucgugccgcccgagaagugcgacacccuccugugcgacaucggggaguccagccccaaccccaccaucgaggagggccgcacgcugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccccugagccggaacuccacccacgagauguacugggucagcugcgggaccggcaacaucguguccgccgugaacaugacgagccgcaugcuccugaaccgguucaccauggcccaccgcaagcccaccuacgagcgcgacgucgaccugggggccggcacccggcacguggccguggagccggaggucgcgaaccucgacaucaucggccagcgcaucgagaacaucaagcacgagcacaaguccaccuggcacuacgacgaggacaaccccuacaagacgugggccuaccacgggagcuacgaggugaagcccagcggcuccgccagcuccauggucaacgggguggugaagcugcugaccaagcccugggacgucaucccgauggugacccagaucgccaugaccgacacgacccccuucggccagcagcggguguucaaggagaaggucgacacccgcacccccaaggccaagcgggggacggcgcagaucauggaggugaccgccaaguggcucuggggcuuccugagccgcaacaagaagccccggaucugcacccgcgaggaguucacccggaaggugcgcuccaacgccgccaucggcgcggucuucguggacgagaaccaguggaacagcgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggccaaggggucccgggcgaucugguacauguggcugggcgcccgcuuccucgaguucgaggcccugggcuucaugaacgaggaccacugguucagccgggagaacucccugagcgggguggagggcgaggggcuccacaagcugggcuacauccugcgcgacaucuccaagaucagcgggggcaacauguacgccgacgacaccgccggcugggacacccggaucaccgaggacgaccuccagaacgaggcgaagaucacggacaucauggagccggagcacgcccugcuggccaaguccaucuucaagcucaccuaccagaacaaggucgugcgcgugcagcggcccgccaagaacgggaccgucauggacgugaucagccgccgcgaccagcggggcuccggccaggugggcaccuacggccugaacacguucaccaacauggaggcccagcugauccgccagauggagagcgaggggaucuucucccccagcgagcucgagaccccgaaccuggcggagcgggcccuggacuggcucgagaagcacggcgucgagcgccugaagcggauggccaucagcggggacgacugcguggugaagcccaucgacgaccgcuucgccaccgcccugacggcgcucaacgacaugggcaagguccggaaggacaucccccagugggagcccuccaagggguggaacgacuggcagcaggucccguucugcagccaccacuuccaccagcugaucaugaaggacggccgcgagaucgugguccccugccggaaccaggacgagcuggugggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgccggccccgucgacugggugcccaccucccgcaccacguggagcauccacgcgcaccaccaguggaugaccaccgaggacaugcuguccguguggaaccgggucuggaucgaggagaacccguggauggaggacaagacccacaucagcuccugggaggacgugcccuaccucgggaagcgcgaggaccaguggugcggcagccugaucggccugacggcccgggccaccugggccaccaacauccagguggccaucaaccagguccgccgccucaucgggaacgagaacuaccuggacuacaugaccuccaugaagcgguucaagaacgagagcgaccccgagggcgcgcugugguga

SEQ ID NO: 8036 - RNA, 9879 nt, Artificial Sequence
  derived and/or modified CDS sequence (opt1) from DENV-1__FJ639694__SS-prME
agcgugaccaugcugcucaugcugaugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcucaagcugcgcgacagcuacacccaggucugcgaccaccggcugauguccgccgccaucaaggacagcaaggccgugcacgccgacaugggcuacuggaucgaguccgagaagaacgagaccuggaagcucgcgcgcgccagcuucaucgaggugaagaccugcaucuggcccaagucccacacgcuguggagcaacggcguccuggaguccgagaugaucauccccaagaucuacgggggcccgaucagccagcacaacuaccggcccggguacuucacccagaccgccggccccuggcaccucgggaagcuggagcuggacuucgaccucugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgguggucccgcaagaugcugaugaccggcacccucgccguguuccugcugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucgggcuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgguaccucccggccaucguccgcgaggccaucaagcgcaagcugcggacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgggggcgcaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacaccaucgagacgcugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccggcagcgcacgccccaggacaaccagcuggccuacguggugaucgggcuccuguucaugauccugacggucgccgcgaacgagaugggccuccuggagaccaccaagaaggaccuggggaucggccacguggccguggggaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggccaaggcgacccgggaggcccagaagcgcaccgccgccgggaucaugaagaaccccaccgucgacggcaucguggccaucgaccuggaccccguggucuacgacgcgaaguucgagaagcagcucggccagaucaugcugcugauccucugcacgucccagauccugcugaugcggaccaccugggcccucugcgagagcaucacccuggccacggggccccugaccacccucugggagggcuccccggggaaguucuggaacaccacgaucgccgugagcauggccaacaucuuccgcggcuccuaccuggcgggcgccgggcuggccuucagccucaugaagucccugggcgggggccggcgcgggaccggcgcccagggcgagacccugggggagaaguggaagcggcagcucaaccagcuguccaagagcgaguucaacaccuacaagcgcuccggcaucauggagguggaccggagcgaggcgaaggaggggcugaagcgcggcgagaucacgaagcacgccgucucccgggggaccgccaagcuccgcugguucguggagcggaaccuggugaagcccgagggcaaggucaucgaccugggcugcgggcgcggcggguggagcuacuacugcgccggccugaagaaggugaccgaggugaagggguacaccaagggcggccccgggcacgaggagcccaucccgauggccacguacggcuggaaccucgucaagcugcacuccgggaaggacguguucuucgugccgcccgagaagugcgacacccugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacgcuggagcagaugcagcgcaagcacggcgggaugcucgugcggaacccgcugucccgcaacagcacccacgagauguacuggguguccugcggcaccgggaacaucgucagcgcggugaacaugaccucccgcaugcugcucaaccgguucaccauggcccaccgcaagcccacguacgagcgggacguggaccugggcgccggcacccgccacgucgccguggagcccgagguggccaaccuggacaucaucgggcagcggaucgagaacaucaagcacgagcacaagagcaccuggcacuacgacgaggacaaccccuacaagaccugggcguaccacggcuccuacgaggucaagccgagcggguccgccagcagcauggugaacggcgucgugaagcuccugacgaagcccugggacgugauccccauggucacccagaucgccaugaccgacaccacgcccuucgggcagcagcgcguguucaaggagaagguggacacccggaccccgaaggccaagcgcggcaccgcccagaucauggaggucacggcgaaguggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacacggccgggugggacacccgcaucaccgaggacgaccugcagaacgaggcccgcaucaccgacaucauggagccggagcacgcgcuccuggccaaguccaucuucaagcugacguaccagaacaaggugguccgggugcagcgccccgccaagaacggcaccgugauggacgucaucagccggcgcgaccagcggggguccggccaggugggcaccuacgggcucaacaccuucacgaacauggaggcccagcugauccgccagauggagagcgagggcaucuucucccccagcgagcuggagacccccaaccucgccgagcgggugcuggacuggcuggagaaguacggggucgagcgccucaagcggauggcgaucuccggcgacgacugcguggugaagccgaucgacgaccgcuucgccaccgcccugaccgcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgcgggguggagccugcgcgagacggccugccucggcaaguccuacgcccagauguggcagcugauguacuuccaccggcgcgaccugcggcucgccgcgaacgccaucugcagcgccguccccguggacuggauccccaccucccgcaccaccuggagcauccacgcccaccaccaguggaugacgaccgaggacaugcuguccguguggaaccgcgucuggaucgaggagaaccccuggauggaggacaagacccacaucagcaacuggggcgacgugccguaccugggcaagcgggaggaccaguggugcggcucccucaucgggcugaccgcccgcgcgacgugggccaccaacauccagguggccaucaaccagguccggcgccugaucggcaacgagaacuaccucgacuacaugaccagcaugaagcgguucaagaacgaguccgaccccgagggggcccugugguga

SEQ ID NO: 8037 - RNA, 9879 nt, Artificial Sequence
  derived and/or modified CDS sequence (opt1) from DENV-1__FJ639695__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaugacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccuguucuccggcgugagcuggaccaugaagaucgggcugggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguuccuccugcugaucauggggcagcucacguggaacgaccugauccgccugugcaucauggugggcgcgaacgccagcgaccgcauggggaugggcaccaccuaccucgcccugauggccaccuucaagaugcggccgauguucgccgucgggcuccuguuccgccggcugacgucccgcgaggugcugcuccugaccaucgggcugagccucguggcguccgucgagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgucucccuguucccccucugccugagcacgaccucccagaagaccaccuggcugcccgugcuccugggcagccuggggugcaagccgcucacgauguuccugaucgccgagaacaagaucuggggccggcgcuccuggccccugaacgaggggaucauggccgugggcaucgucagcauccuccugagcucccugcucaagaacgacgugccccuggccgggccccugaucgccggcggcaugcucaucgcgugcuacgugaucagcggguccagcgccgaccugucccuggagaaggccgccgaggucagcugggaggaggaggccgagcacuccggcgcgagccacaacauccucguggaggugcaggacgacgggaccaugaagaucaaggacgaggagcgggacgacacccugaccauccugcucaaggccacccugcuggccgucuccggcguguacccgcucagcauccccgccacgcuguucgugugguacuucuggcagaagaagaagcagcgcuccgggguccugugggacacccccagcccgcccgagguggagcgggccgugcuggacgacggcaucuaccgcaucaugcagcggggccuccuggggcgcucccaggucggcguggggguguuccaggagaacgucuuccacaccauguggcacgugacccggggcgcggugcugauguaccaggggaagcgccucgagcccagcugggccuccgucaagaaggaccugaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcucgacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucguccgggaggccaucaagcgcaagcuccgcacccugauccuggcccccacccgggugguggccuccgagauggcggaggcccucaagggcaugcccauccgcuaccagacgaccgccgucaagagcgagcacaccggcaaggagaucguggaccugaugugccacgccaccuucacgaugcggcugcucucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccucaagcccgugauccugaaggacgggcccgagcgcgugauccuggccggccccaugccggucacgguggccuccgccgcgcagcggcgcgggcggaucggccgcagccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucgucgagcugaugcgccgcggggaccuccccguguggcugagcuacaagguggccagcgagggcuuccaguacuccgaccgccgguggugcuucgacggcgagcgcaacaaccagguccuggaggagaacauggacguggagaucuggacgaaggagggggagcggaagaagcuccgcccccgguggcuggacgcccgcaccuacagcgacccccuggcccuccgggaguucaaggaguucgcggccggccgccgguccgugagcggggaccugauccuggagaucggcaagcucccgcagcaccugacccagcgcgcccagaacgcccuggacaaccucgucaugcugcacaacuccgagcagggcgggcgggcguaccgccacgccauggaggagcugcccgacaccaucgagacgcucaugcugcuggcccucaucgccgugcugaccggcggggugacccuguucuuccucagcggccgggggcugggcaagaccuccaucggccugcucugcgucauggccagcuccgugcugcuguggauggcgagcguggagccccacuggaucgccgccuccaucauccucgaguucuuccugaugguccugcucauccccgagccggaccgccagcggacgccccaggacaaccagcuggccuacguggugaucgggcuccucuucaugauccugacggucgccgcgaacgagaugggccugcucgagaccaccaagaaggaccuggggaucggccacguggccguggggaaccaccaccacgccgccaugcuggacgucgaccuccaccccgccagcgcguggacccuguacgccguggccacgaccaucaucaccccgaugaugcgccacaccaucgagaacacgaccgccaacaucucccugaccgccaucgcgaaccaggccgccauccucaugggccuggacaagggcuggcccaucagcaagauggacaucggggugccccugcucgcccugggcugcuacucccaggucaacccccugacccucacggcggccgugcugaugcugguggcccacuacgccaucaucgggccgggccuccaggccaaggcgacccgcgaggcccagaagcggaccgccgccgggaucaugaagaaccccaccgucgacggcaucguggccaucgaccuggaccccguggucuacgacgcgaaguucgagaagcagcugggccagaucaugcuccugauccugugcacgagccagauccuccugaugcgcaccaccugggcccugugcgaguccaucacccucgccacggggccccugaccacccugugggagggcagcccggggaaguucuggaacaccacgaucgccguguccauggccaacaucuuccggggcagcuaccucgcgggcgccgggcuggccuucagccugaugaagucccucggcgggggccgccgggggaccggcgcccagggcgagacccugggggagaaguggaagcgccagcugaaccagcucagcaaguccgaguucaacaccuacaagcggagcggcaucauggagguggaccgcuccgaggcgaaggaggggcugaagcggggcgagacgaccaagcacgccgucagccgcgggaccgccaagcugcggugguucguggagcgcaaccuggugaagcccgagggcaaggucaucgaccucggcugcgggcggggcgggugguccuacuacugcgccggccugaagaaggugaccgaggugaagggguacacgaagggcggccccgggcacgaggagcccaucccgauggccaccuacggcuggaaccuggucaagcuccacagcgggaaggacguguucuucaucccgcccgagaagugcgacacccugcugugcgacaucggcgaguccagccccaacccgaccaucgaggaggggcgcacgcuccgggugcugaagauggucgagcccuggcugcgcggcaaccaguucugcaucaagauccucaaccccuacaugcccuccgugguggagacccuggagcagaugcagcggaagcacggcgggaugcugguccgcaacccgcucagccggaacuccacccacgagauguacugggugagcugcggcaccgggaacaucguguccgcggucaacaugaccagccgcaugcugcugaaccgcuucacgauggcccaccggaagcccaccuacgagcgcgacguggaccucggcgccggcacccggcacguggccgucgagcccgagguggccaaccuggacaucaucgggcagcgcaucgagaacaucaagcacgagcacaaguccaccuggcacuacgacgaggacaaccccuacaagacgugggcguaccacggcagcuacgaggugaagccguccgggagcgccagcuccauggucaacggcguggucaagcugcucaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcuguggggcuuccugagccgcaacaagaagccccggaucugcacccgcgaggaguucacccggaagguccgcuccaacgccgccaucggggccguguucguggacgagaaccaguggaacagcgcgaaggaggccgucgaggacgagcgguucugggaccucgugcaccgcgagcgggagcugcacaagcagggcaagugcgccacgugcguguacaacaugauggggaagcgcgagaagaagcugggcgaguucgggaaggccaagggcucccgggccaucugguacauguggcucggcgcgcgcuuccuggaguucgaggcccugggguucaugaacgaggaccacugguucagccgggagaacucccucagcggcgucgagggggagggccugcacaagcugggguacauccuccgcgacaucuccaagauccccggcggcaacauguacgccgacgacaccgccgggugggacacccggaucaccgaggacgaccugcagaacgaggcccgcaucacggacaucauggagccggagcacgcgcugcucgccaagagcaucuucaagcugaccuaccagaacaagguggugcgcguccagcggcccgccaagaacggcaccgugauggacgugaucucccgccgggaccagcgcgggagcggccaggucggcaccuacgggcugaacacguucaccaacauggaggcccagcucauccggcagauggaguccgagggcaucuucagccccuccgagcuggagacccccaaccuggccgagcgcgugcucguguggcuggagaaguacggggucgagcggcugaagcgcauggcgaucagcggcgacgacugcguggugaagccgaucgacgaccgguucgccaccgcccucacggcccugaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcucguggggcgggcccgcgugagccagggcgcgggguggucccugcgggagaccgccugccugggcaagagcuacgcccagauguggcagcucauguacuuccaccgccgggaccugcgccuggccgcgaacgccaucugcuccgccguccccguggacuggauccccaccagccggaccacgugguccauccacgcccaccaccaguggaugaccaccgaggacaugcucagcguguggaaccgcgucuggaucgaggagaaccccuggauggaggacaagacccacaucuccagcuggggcgacgugccguaccugggcaagcgcgaggaccaguggugcggcucccugaucgggcucacggcccgggcgaccugggccaccaacauccagguggccaucaaccagguccgccggcugaucggcaacgagaacuaccuggacuacaugaccagcaugaagcgcuucaagaacgaguccgaccccgagggggcccucugguga

SEQ ID NO: 8038 - RNA, 9879 nt, Artificial Sequence
  derived and/or modified CDS sequence (opt1) from DENV-1__FJ639696__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgcgaacuuccgcgccgaccgggugaucgacccccgccggugccucaagccggugauccugaaggacgggcccgagcgcgucauccuggccggccccaugcccgugaccgucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccgugcugaccggcggggucacccuguucuuccucagcggccgggggcugggcaagacguccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccagcgcguggacgcuguacgccguggccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgucccccugcucgcccuggggugcuacucccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggcgaaggagggccugaagcgcggggagaccaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugacggaggucaagggguacaccaagggcgggcccggccacgaggagcccauccccauggccaccuacggguggaaccuggugaagcuccacagcggcaaggacguguucuucgucccgcccgagaagugcgacacccugcugugcgacaucggggaguccagccccaaccccacgaucgaggagggccgcacccuccgggugcugaagaugguggagccguggcugcgcgggaaccaguucugcaucaagauccucaaccccuacaugcccuccgucguggagacccuggagcagaugcagcggaagcacggcggcaugcuggugcgcaacccccucagccggaacuccacccacgagauguacugggucagcugcgggacgggcaacaucguguccgcggugaacaugaccagccgcaugcugcugaaccgguucaccauggcccaccgcaagccgaccuacgagcgcgacgucgaccucggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagcccagcggcuccgccagcuccauggucaacgggguggugaagcugcucaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccugagccgcaacaagaagccgcggaucugcacccgcgaggaguucacgcggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaaguccaucuucaagcugaccuaccagaacaaggucgugcgcgugcagcggcccgccaagaacgggaccgucauggacgugaucagccgccgcgaccagcggggcuccggccaggugggcacguacggccugaacaccuucaccaacauggaggcccagcucauccgccagauggagagcgaggggaucuucuccccgagcgagcuggagacccccaaccuggccgagcgggcgcucgacuggcuggagaagcacggcgucgagcgccugaagcggauggccaucagcggggacgacugcguggugaagcccaucgacgaccgcuucgccacggcccucaccgcccugaacgacaugggcaagguccggaaggacaucccccagugggagccguccaagggguggaacgacuggcagcagguccccuucugcagccaccacuuccaccagcugaucaugaaggacggccgcgagaucgugguccccugccggaaccaggacgagcucgugggccgcgcgcgggugucccagggggccggcuggagccugcgcgagaccgccugccuggggaaguccuacgcccagauguggcagcucauguacuuccaccggcgcgaccugcggcuggcggccaacgccaucugcagcgccguccccguggacugggugccgaccucccgcacgaccuggagcauccacgcccaccaccaguggaugaccaccgaggacaugcucuccgucuggaaccggguguggaucgaggagaaccccuggauggaggacaagacgcacaucagcuccugggaggacgugcccuaccugggcaagcgcgaggaccaguggugcgggagccugaucggccucaccgcgcgggccaccugggccaccaacauccaggucgccaucaaccaggugcgccgccugaucggcaacgagaacuaccuggacuacaugacguccaugaagcgguucaagaacgagagcgaccucgagggggcccugugguga

SEQ ID NO: 8039 - RNA, 9879 nt, Artificial Sequence
  derived and/or modified CDS sequence (opt1) from DENV-1__HM181937__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcacaaggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggcccggaucacggacaucauggagccggagcacgcgcugcuggccaaguccaucuucaagcucaccuaccagaacaagguggugcgcguccagcgccccgccaagaacggcaccgugauggacgugaucagccggcgcgaccagcggggguccggccaggucggcaccuacgggcugaacacguucaccaacaucgaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggauccccaccucccgcaccacguggagcauccacgcccaccaccaguggaugaccaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugacggcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8040 - RNA, 9879 nt, Artificial Sequence
  derived and/or modified CDS sequence (opt1) from DENV-1__HM181939__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgcgaacuuccgcgccgaccgggugaucgacccccgccggugccucaagccggugauccugaaggacgggcccgagcgcgucauccuggccggccccaugcccgugaccgucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccgugcugaccggcggggucacccuguucuuccucagcggccgggggcugggcaagacguccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccagcgcguggacgcuguacgccguggccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgucccccugcucgcccuggggugcuacucccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggcgaaggagggccugaagcgcggggagaccaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugacggaggucaagggguacaccaagggcgggcccggccacgaggagcccauccccauggccaccuacggguggaaccuggugaagcuccacagcggcaaggacguguucuucgucccgcccgagaagugcgacacccugcugugcgacaucggggaguccagccccaaccccacgaucgaggagggccgcacccuccgggugcugaagaugguggagccguggcugcgcgggaaccaguucugcaucaagauccucaaccccuacaugcccuccgucguggagacccuggagcagaugcagcggaagcacggcggcaugcuggugcgcaacccccucagccggaacuccacccacgagauguacugggucagcugcgggacgggcaacaucguguccgcgaucaacaugaccagccgcaugcugcugaaccgguucaccauggcccaccgcaagccgaccuacgagcgcgacguggaccucggggccggcacccggcacgucgccguggagcccgagguggccaaccuggacaucaucggccagcgcaucgagaacaucaagcacgagcacaaguccacguggcacuacgacgaggacaaccccuacaagaccugggcguaccacgggagcuacgaggucaagcccagcggcuccgccagcuccauggugaacggggucgugaagcugcucaccaagccgugggacgugauccccauggucacccagaucgccaugacggacaccacccccuucggccagcagcggguguucaaggagaagguggacacccgcacgcccaaggccaagcgggggaccgcccagaucauggaggucaccgcgaaguggcuguggggcuuccugagccgcaacaagaagccgcggaucugcacccgcgaggaguucacgcggaaggugcgcuccaacgccgccaucggcgccguguucgucgacgagaaccaguggaacagcgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaacuccaucuucaagcugaccuaccagaacaaggugguccgcgugcagcggcccgccaagaacgggaccgugauggacgucaucagccgccgcgaccagcggggcuccggccaggugggcacguacggccugaacaccuucaccaacauggaggcccagcucauccgccagauggagagcgaggggaucuucuccccgagcgagcuggagacccccaaccuggccgagcgggugcucgacuggcuggagaagcacggcgucgagcgccugaagcggauggcgaucagcggggacgacugcguggugaagcccaucgacgaccgcuucgccacggcccucaccgcccugaacgacaugggcaagguccggaaggacaucccccagugggagccguccaagggguggaacgacuggcagcagguccccuucugcagccaccacuuccaccagcugaucaugaaggacggccgcgagaucgugguccccugccggaaccaggacgagcucgugggccgcgcccgggugucccagggggcgggcuggagccugcgcgagaccgccugccuggggaaguccuacgcccagauguggcagcucauguacuuccaccggcgcgaccugcggcuggccgcgaacgccaucugcagcgccguccccguggacugggugccgaccucccgcacgaccuggagcauccacgcccaccaccaguggaugaccaccgaggacaugcucuccgucuggaaccggguguggaucgaggagaaccccuggauggaggacaagacgcacaucagcuccugggaggacgugcccuaccugggcaagcgcgaggaccaguggugcgggagccugaucggccucaccgcccgggcgaccugggccaccaacauccaggucgccaucaaccaggugcgccgccugaucggcaacgagaacuaccuggacuacaugacguccaugaagcgguucaagaacgagagcgaccccgagggggcccucugguga

SEQ ID NO: 8041 - RNA, 9879 nt, Artificial Sequence
  derived and/or modified CDS sequence (opt1) from DENV-1__HM181942__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccuggcgccccacgugggccucgggcuggagacccggacggagaccuggauguccagcgagggcgccuggaagcagauccagcgggucgagaccugggcccugcgccaccccggguucaccgugaucgcccucuuccuggcgcacgccaucggcacguccaucacccagaaggggaucaucuucauccugcucaugcuggugacccccagcauggccaugcggugcgucggcaucggcucccgcgacuucguggaggggcugagcggcgccaccuggguggacgucgugcucgagcacggguccugcgugacgaccauggccaaggacaagcccacccuggacaucgagcugcucaagaccgaggucacgaaccccgcggugcugcggaagcugugcaucgaggccaagaucagcaacaccaccaccgacucccgcugcccgacgcagggcgaggccacccucguggaggagcaggacgccaacuucgucugccggcgcaccuucguggaccggggcugggggaacggcugcgggcuguucggcaaggggagccugaucacgugcgccaaguucaagugcgugacgaagcucgagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccucccaggagaccuggaaccggcaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccgccugaagauggacaagcucacgcugaagggcaugagcuacgucaugugcaccggguccuucaagcuggagaaggagguggcggagacccagcacggcaccgugcucguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcugagcugguucaagaagggguccagcaucggcaagauguucgaggccaccgcccgcggggcccggcgcauggcgauccucggcgacaccgccugggacuucggguccaucggcggcguguucaccagcgucgggaagcuggugcaccagaucuucggcacggccuacggggugcuguucuccggcgucagcuggaccaugaagaucgggaucggcgugcuccugaccuggcugggccucaacucccgcagcaccucccugagcaugacgugcaucgccguggggcuggucacccucuaccugggcgugauggugcaggccgacagcgggugcgucaucaacuggaagggccgggagcugaagugcggguccggcaucuucgugaccaacgaggugcacaccuggacggagcaguacaaguuccaggcggacagcccgaagcgccucuccgccgccaucggcaaggccugggaggagggggucugcggcauccggagcgccacccgccuggagaacaucauguggaagcagaucuccaacgagcugaaccacauccuccuggagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgccgacaugggcuacuggaucgaguccgagaagaacgagacguggaagcucgcgcgggccagcuucaucgaggucaagaccugcaucuggcccaagucccacacccuguggagcaacggcgugcuggaguccgagaugaucauccccaagaucuacgggggcccgaucagccagcacaacuaccgccccggguacuucacccagacggccggccccuggcaccucgggaagcuggagcuggacuucgaccucugcgagggcaccaccguggucguggacgagcacugcggcaaccgggggccgucccugcgcaccacgaccgugaccggcaagaucauccacgaguggugcugccggagcugcacccugccgccccugcgcuucaagggggaggacggcugcugguacgggauggagauccggcccgucaaggagaaggaggagaaccuggucaagagcaugguguccgccggcagcggcgaggucgacuccuucagccuggggcuccugugcaucuccaucaugaucgaggaggugaugcgcagccgguggucccgcaagaugcugaugacgggcacccucgccguguucuuccugcugaucauggggcagcucaccuggaacgaccugauccggcugugcaucauggucggcgcgaacgccagcgaccgcauggggaugggcaugaccuaccucgcccugauggccacguucaagaugcgcccgauguucgccgugggccuccuguuccggcgccugaccucccgggaggugcugcuccugaccaucgggcugagccucgucgcguccguggagcugcccaacagccuggaggagcucggcgacgggcuggccaugggcaucaugauccugaagcuccugaccgacuuccagucccaccagcugugggccacgcuccugagccugaccuucaucaagaccaccuucucccuccacuacgccuggaagacgauggcgaugguccugagcaucgugucccuguucccccucugccugagcaccaccucccagaagaccacguggcugcccgugcuccugggcagccuggggugcaagccgcucaccauguuccugaucgccgagaacaagaucuggggccgcaagagcuggccccugaacgaggggaucauggccgucggcaucguguccauccuccugagcucccugcucaagaacgacgugccccuggccgggccccugaucgccggcggcaugcucaucgcgugcuacgucaucagcggguccagcgccgaccugucccuggagaaggccgccgaggugagcugggaggaggaggccgagcacuccggcgcgagccacaacauccucguggagguccaggacgacgggaccaugaagaucaaggacgaggagcgggacgacacccugacgauccugcucaaggccacccugcuggccguguccggcguguacccgcucagcauccccgccacccuguucgucugguacuucuggcagaagaagaagcagcgcuccggggugcugugggacacccccagcccgcccgagguggagcgggccguccucgacgacggcaucuaccgcaucaugcagcggggccugcuggggcgcucccaggugggcgugggggucuuccaggagaacguguuccacaccauguggcacgugacgcggggcgcgguccugauguaccaggggaagcgccucgagcccagcugggccuccgugaagaaggaccugaucagcuacggcggcggguggcggcugcagggcuccuggaacaccggggaggaggugcaggucaucgccguggagcccggcaagaaccccaagaacgugcagaccgcccccgggaccuucaagacgagcgagggcgaggucggcgccaucgcgcucgacuucaagcccgggaccagcggcucccccaucgugaaccgcgaggggaagaucgugggccuguacggcaacggggucgugaccaccagcggcacguacguguccgccaucgcccaggccaaggcgagccaggaggggccccugccggagaucgaggacgaggucuuccggaagcgcaaccucaccaucauggaccugcaccccggcuccgggaagacccggcgcuaccugcccgccaucgugcgggaggccaucaagcgcaagcuccggacccugauccuggccccgacgcgcguggucgccagcgagauggcggaggcccucaagggcaugcccauccgcuaccagaccaccgccgugaaguccgagcacaccggcaaggagaucguggaccugaugugccacgccacguucaccaugcggcugcucagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgcgaacuuccgcgccgaccgggugaucgacccccgccggugccucaagccggugauccugaaggacgggcccgagcgcgucauccuggccggccccaugcccgugaccgucgccagcgccgcgcagcggcgcgggcggaucggccgcaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgggagaaguccgccgcgaucgacggggaguaccgccugcgcggcgaggcccggaagacguucguggagcugaugcgccgcggggaccucccgguguggcuguccuacaaggucgccagcgagggcuuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccccagcaccugacccagcgcgcccagaacgcccuggacaaccucgugaugcugcacaacuccgagcagggcgggcgggcguaccgccacgccauggaggagcugccggacacgaucgagacccucaugcugcuggcccucaucgccgugcugaccggcggggucacccuguucuuccucagcggccgggggcugggcaagacguccaucggccugcucugcgugauggccagcuccgugcugcuguggauggcgagcgucgagccccacuggaucgccgccuccaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagaccaccaagaaggaccuggggaucggccacguggccgucgagaaccaccaccacgccgccaugcuggacguggaccuccaccccgccagcgcguggacgcuguacgccguggccaccaccaucaucacccccaugaugcgccacacgaucgagaacaccaccgccaacaucucccugaccgccaucgcgaaccaggccgccauccucauggggcuggacaagggcuggccgaucagcaagauggacaucggcgucccccugcucgcccuggggugcuacucccaggugaacccccugacgcucaccgcggccgugcugaugcuggucgcccacuacgccaucaucggccccgggcuccaggccaaggcgacccgggaggcccagaagcgcaccgccgccggcaucaugaagaacccgacgguggacgggaucguggccaucgaccuggaccccgucguguacgacgcgaaguucgagaagcagcugggccagaucaugcuccugauccugugcaccagccagauccuccugaugcgcaccaccugggcccugugcgaguccaucacgcucgccaccggcccccugaccacccugugggaggggagccccggcaaguucuggaacacgaccaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucagcaaguccgaguucaacacguacaagcggagcgggaucauggaggucgaccgcuccgaggcgaaggagggccugaagcgcggggagaccaccaagcacgccgugagccgcggcaccgccaagcugcggugguucguggagcgcaaccucgucaagccggaggggaaggugaucgaccugggcugcggccgcggcgggugguccuacuacugcgccgggcugaagaaggugacggaggucaagggguacaccaagggcgggcccggccacgaggagcccauccccauggccaccuacggguggaaccuggugaagcuccacagcggcaaggacguguucuucgucccgcccgagaagugcgacacccugcugugcgacaucggggaguccagccccaaccccacgaucgaggagggccgcacccuccgggugcugaagaugguggagccguggcugcgcgggaaccaguucugcaucaagauccucaaccccuacaugcccuccgucguggagacccuggagcagaugcagcggaagcacggcggcaugcuggugcgcaacccccucagccggaacuccacccacgagauguacugggucagcugcgggacgggcaacaucguguccgcggugaacaugaccagccgcaugcugcugaaccgguucaccauggcccaccgcaagccgaccuacgagcgcgacgucgaccucggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagcccagcggcuccgccagcuccauggucaacgggguggugaagcugcucaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccugagccgcaacaagaagccgcggaucugcacccgcgaggaguucacgcggaaggugcgcuccaacgccgccaucggcgccgucuucguggacgagaaccaguggaacagcgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggucccgggccaucugguacauguggcucggcgcgcgcuuccuggaguucgaggcccugggcuucaugaacgaggaccacugguucagccgggagaacucccucagcgggguggagggcgaggggcugcacaagcugggcuacauccuccgcgacaucuccaagaucagcgggggcaacauguacgccgacgacaccgccggcugggacacccggaucacggaggacgaccugcagaacgaggccaagaucaccgacaucauggagcccgagcacgcgcugcucgccaacuccaucuucaagcugaccuaccagaacaaggucgugcgcgugcagcggcccgccaagaacgggaccgucauggacgugaucagccgccgcgaccagcggggcuccggccaggugggcacguacggccugaacaccuucaccaacauggaggcccagcucauccgccagauggagagcgaggggaucuucuccccgagcgagcuggagacccccaaccuggccgagcggguccucgacuggcuggagaagcacggcguggagcgccugaagcggauggcgaucagcggggacgacugcguggucaagcccaucgacgaccgcuucgccacggcccucaccgcccugaacgacaugggcaaggugcggaaggacaucccccagugggagccguccaagggguggaacgacuggcagcagguccccuucugcagccaccacuuccaccagcugaucaugaaggacggccgcgagaucgucgugcccugccggaaccaggacgagcucgugggccgcgcccgggucucccagggggcgggcuggagccugcgcgagaccgccugccuggggaaguccuacgcccagauguggcagcucauguacuuccaccggcgcgaccugcggcuggccgcgaacgccaucugcagcgccgugcccguggacugggucccgaccucccgcacgaccuggagcauccacgcccaccaccaguggaugaccaccgaggacaugcucuccguguggaaccggguguggaucgaggagaaccccuggauggaggacaagacgcacaucagcuccugggaggacguccccuaccugggcaagcgcgaggaccaguggugcgggagccugaucggccucaccgcccgggcgaccugggccaccaacauccagguggccaucaaccaggugcgccgccugaucggcaacgagaacuaccuggacuacaugacguccaugaagcgguucaagaacgagagcgaccccgagggggcccucugguga

SEQ ID NO: 8042 - RNA, 9879 nt, Artificial Sequence
  derived and/or modified CDS sequence (opt1) from DENV-1__HM488255__SS-prME
agcgugaccaugcugcucaugcugaugcccaccgcccuggccuuccaccucaccacccgcggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagagcgccuggaagcagauccagcgggucgagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugcccgacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccccuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuucuccacccaggacgagaagggcgucacgcagaacgggcggcugaucaccgccaacccgaucgugaccgacaaggagaagcccgugaacaucgaggccgagccgcccuucggcgagagcuacaucgucaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgugggcaagcugguccaccagaucuucgggaccgccuacggcguccucuucagcgggguguccuggaccaugaagaucggcaucgggguccugcugacguggcucggccugaacagccgcuccaccagccuguccaugaccugcaucgccgugggccucgugacccuguaccugggggucauggugcaggccgacagcggcugcgugaucaacuggaaggggcgggagcucaagugcggcagcgggaucuucgucacgaacgaggugcacaccuggaccgagcaguacaaguuccaggcggacuccccgaagcgccugagcgccgccaucggcaaggccugggaggagggcgugugcgggauccgguccgccacccgccuggagaacaucauguggaagcagaucagcaacgagcucaaccacauccugcuggagaacgacaugaaguucaccgucguggugggcgacgucgcggggauccucgcccagggcaagaagaugauccggccccagcccauggaguacaaguacuccuggaaguccugggggaaggccaagaucaucggcgccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacuccuacacccaggucugcgaccaccgccucaugagcgccgccaucaaggacuccaaggccgugcacgccgacaugggguacuggaucgagagcgagaagaacgagaccuggaagcuggcgcgggccuccuucaucgaggugaagaccugcaucuggcccaagagccacacgcugugguccaacggcguccucgagagcgagaugaucauccccaagaucuacggcgggccgaucucccagcacaacuaccgccccggcuacuucacccagaccgccgggcccuggcaccugggcaagcuggagcucgacuucgaccugugcgaggggaccacggugguggucgacgagcacugcggcaaccggggcccgagccugcgcaccaccaccgugacggggaagaucauccacgaguggugcugccgguccugcacccugccgccccuccgcuuccggggcgaggacgggugcugguacggcauggagauccgccccgugaaggagaaggaggagaaccuggucaagagcauggugagcgccggguccggcgagguggacagcuucucccucggccugcugugcaucagcaucaugaucgaggaggucaugcggucccgcuggagccggaagaugcucaugaccgggacccuggccguguuccugcuccugaucaugggccagcugacguggaacgaccucauccgccugugcaucauggugggggcgaacgccuccgaccgcaugggcauggggaccaccuaccuggcccucauggccaccuucaagaugcggccgauguucgccgucgggcugcuguuccgccggcucacgagccgcgaggugcugcugcucaccaucggccugucccugguggcgagcgucgagcuccccaacucccuggaggagcugggggacggccucgccauggggaucaugauccugaagcugcucaccgacuuccagagccaccagcugugggccacccugcucucccugacguucaucaagaccaccuucagccugcacuacgccuggaagaccauggcgauggugcucuccaucgucagccuguucccccugugccucuccacgaccagccagaagaccaccuggcugcccgugcugcucggcucccugggcugcaagccgcugacgauguuccucaucgccgagaacaagaucugggggcggcgcagcuggccccugaacgagggcaucauggccguggggaucgucagcauccugcucuccagccugcugaagaacgacgugccccucgccggcccccugaucgccgggggcaugcugaucgcgugcuacgugaucuccggcagcuccgccgaccucagccuggagaaggccgccgaggucuccugggaggaggaggccgagcacagcggggcgucccacaacauccugguggaggugcaggacgacggcaccaugaagaucaaggacgaggagcgggacgacacccucaccauccugcugaaggccacccuccuggccgucagcgggguguacccgcuguccauccccgccacccucuucgugugguacuucuggcagaagaagaagcagcgcagcggcguccugugggacacccccagcccgcccgagguggagcgggccgugcuggacgacgggaucuaccgcaucaugcagcggggccugcucggccgcagccaggucggggugggcguguuccaggagaacgucuuccacaccauguggcacgugacccgcggggcggugcugauguaccagggcaagcgccuggagcccuccugggccagcgucaagaaggaccucaucuccuacgggggcggcuggcggcugcaggggagcuggaacacgggcgaggagguccaggugaucgccgucgagcccgggaagaaccccaagaacgugcagaccgcccccggcaccuucaagacccccgagggggaggugggcgccaucgcgcuggacuucaagcccggcacguccgggagccccaucgucaaccgcgagggcaagaucguggggcucuacggcaacggcguggucaccaccagcgggaccuacguguccgccaucgcccaggccaaggcgagccaggagggcccgcugcccgagaucgaggacgagguguuccggaagcgcaaccugacgaucauggaccuccaccccggguccggcaagacccggcgcuaccugccggccaucguccgggaggccaucaagcgcaagcugcgcacccucauccuggcccccacccgggugguggccagcgagauggcggaggcccugaaggggaugcccauccgcuaccagacgaccgccgucaaguccgagcacaccggcaaggagaucguggaccucaugugccacgccaccuucacgaugcggcugcugagccccgugcgcgucccgaacuacaacaugaucaucauggacgaggcccacuucaccgaccccuccagcaucgcggcccggggcuacaucuccacccgcguggggaugggcgaggccgccgccaucuucaugaccgcgacgccgcccgggagcguggaggccuucccgcaguccaacgccgucauccaggacgaggagcgggacauccccgagcgcagcuggaacuccggcuacgaguggaucaccgacuuccccgggaagaccgugugguucgugcccagcaucaaguccggcaacgacaucgccaacugccuccggaagaacggcaagcgcgucauccagcugagccggaagaccuucgacacggaguaccagaagaccaagaacaacgacugggacuacguggugaccaccgacaucuccgagaugggggcgaacuuccgcgccgaccgggucaucgacccgcgccggugccugaagcccgugauccucaaggacggccccgagcgcgugauccuggccgggcccaugccggucacgguggccagcgccgcgcagcggcgcggccggaucgggcgcaaccacaacaaggagggcgaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgaucgacggcgaguaccggcuccgcggggaggcccggaagaccuucgucgagcugaugcgccggggcgaccugcccguguggcucagcuacaagguggccagcgagggguuccaguacuccgaccgccgguggugcuucgacggcgagcgcaacaaccagguccuggaggagaacauggacguggagaucuggacgaaggagggcgagcggaagaagcugcgcccccgguggcucgacgcccgcaccuacagcgacccccuggcccugcgggaguucaaggaguucgcggccgggcgccgguccgugagcggcgaccucauccuggagaucgggaagcugccgcagcaccucacccagcgcgcccagaacgcccuggacaaccuggucaugcuccacaacuccgagcagggcggccgggcguaccgccacgccauggaggagcugcccgacaccaucgagacgcugaugcuccuggcccugaucgccgugcucaccgggggcgugacccuguucuuccugagcgggcggggccucgggaagaccuccaucggccugcugugcgucauggccagcuccgugcuccuguggauggcgagcguggagccccacuggaucgccgccuccaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccaccaagaaggaccucggcaucgggcacguggccgugggcaaccaccaccacgccgccaugcuggacgucgaccugcaccccgccagcgcguggacccucuacgccguggccacgaccaucaucaccccgaugaugcgccacaccaucgagaacacgaccgccaacaucucccugaccgccaucgcgaaccaggccgccauccugauggggcucgacaagggcuggcccaucagcaagauggacaucggcgugccccugcuggcccucgggugcuacucccaggucaacccccugacccugacggcggccgugcucaugcugguggcccacuacgccaucaucggcccggggcugcaggccaaggcgacccgcgaggcccagaagcggaccgccgccggcaucaugaagaaccccaccgucgacgggaucguggccaucgaccucgaccccguggucuacgacgcgaaguucgagaagcagcugggccagaucaugcugcucauccugugcacgagccagauccugcucaugcgcaccaccugggcccugugcgaguccaucacccuggccacgggcccccucaccacccugugggaggggagcccgggcaaguucuggaacaccacgaucgccguguccauggccaacaucuuccgggggagcuaccuggcgggcgccggccucgccuucagccugaugaagucccuggggcgcggccggcgcgggaccggcgcccagggggagacccucggcgagaaguggaagcggcagcugaaccagcugagcaaguccgaguucaacaccuacaagcgcagcggcaucauggagguggaccgguccgaggcgaaggaggggcucaagcgcggcgagacgaccaagcacgccgucagccgggggaccgccaagcugcgcugguucguggagcggaaccuggugaagcccgagggcaaggucaucgaccuggggugcggccgcggcgggugguccuacuacugcgccggccucaagaaggugaccgaggugaagggguacacgaagggcgggcccggccacgaggagcccaucccgauggccaccuacggcuggaaccuggucaagcugcacagcgggaaggacguguucuucaucccgcccgagaagugcgacacccuccugugcgacaucggcgaguccagccccaacccgaccaucgaggaggggcggacgcugcgcgugcucaagauggucgagcccuggcugcggggcaaccaguucugcaucaagauccugaaccccuacaugcccuccgugguggagacccucgagcagaugcagcgcaagcacgggggcaugcugguccggaacccgcugagccgcaacuccacccacgagauguacugggugagcugcggcaccgggaacaucguguccgcggucaacaugaccagccgcaugcuccugaaccgguucacgauggcccaccgcaagcccaccuacgagcgggacguggaccugggcgccgggacccgccacguggccgucgagcccgagguggccaaccucgacaucaucggccagcggaucgagaacaucaagcacgagcacaaguccaccuggcacuacgacgaggacaaccccuacaagacgugggcguaccacggcagcuacgaggugaagccguccgggagcgccagcuccauggucaacggcguggucaagcugcugaccaagcccugggacgugauccccauggugacccagaucgccaugaccgacacgacccccuucgggcagcagcgcgucuucaaggagaagguggacacccggaccccgaaggccaagcgcggcacggcccagaucauggaggugaccgcgaaguggcucuggggguuccugagccggaacaagaagccccgcaucugcacccgggaggaguucacccgcaagguccgguccaacgccgccaucggcgccguguucguggacgagaaccaguggaacagcgcgaaggaggccgucgaggacgagcgcuucugggaccuggugcaccgggagcgcgagcuccacaagcagggcaagugcgccacgugcguguacaacaugauggggaagcgggagaagaagcugggcgaguucgggaaggccaagggcucccgcgccaucugguacauguggcugggggcgcgguuccucgaguucgaggcccugggcuucaugaacgaggaccacugguucagccgcgagaacucccugagcggcgucgagggggagggccuccacaagcugggguacauccugcgggacaucuccaagauccccggcgggaacauguacgccgacgacaccgccggcugggacacccgcaucaccgaggacgaccuccagaacgaggcccgcaucacggacaucauggagccggagcacgcgcugcuggccaagagcaucuucaagcucaccuaccagaacaagguggugcggguccagcgccccgccaagaacggcaccgugauggacgugaucucccggcgcgaccagcgggggagcggccaggucgggaccuacggccugaacacguucaccaacauggaggcccagcugauccgccagauggaguccgagggcaucuucagccccuccgagcucgagacccccaaccuggccgagcgggugcuggacuggcucgagaaguacgggguggagcgccugaagcggauggcgaucagcggcgacgacugcgucgugaagccgaucgacgaccgcuucgccaccgcccugacggcccucaacgacauggggaaggugcggaaggacaucccccagugggagcccuccaagggcuggaacgacuggcagcagguccccuucugcagccaccacuuccaccagcugaucaugaaggacgggcgcgagaucguggugccgugccggaaccaggacgagcuggucggccgcgcccgggugagccagggcgcgggguggucccuccgcgagaccgccugccugggcaagagcuacgcccagauguggcagcugauguacuuccaccggcgcgaccuccggcuggccgcgaacgccaucugcuccgccgugcccgucgacuggauccccaccagccgcaccacgugguccauccacgcccaccaccaguggaugaccaccgaggacaugcugagcguguggaaccgcguguggaucgaggagaaccccuggauggaggacaagacccacaucuccagcuggggcgacgucccguaccucggcaagcgggaggaccaguggugcgggucccugaucggccugacggcccgcgcgaccugggccaccaacauccagguggccaucaaccaggugcggcgccucaucggcaacgagaacuaccuggacuacaugaccagcaugaagcgguucaagaacgaguccgaccccgagggggcccugugguga

SEQ ID NO: 8043 - RNA, 9879 nt, Artificial Sequence
  derived and/or modified CDS sequence (opt1) from DENV-1__HM181944__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucagcgaggccgagcccgacgacguggacugcuggugcaacgccaccgacaccugggugaccuacgggaccugcucccagaccggcgagcaccggcgcgacaagcggagcguggcccucgcgccccacgugggccuggggcuggagacccggacggagaccuggauguccagcgagggcgccuggaagcagauccagcgggucgagaccugggcccuccgccaccccggguucaccgugaucgcccuguuccuggcgcacgccaucggcacguccaucacccagaaggggaucaucuucauccuccugaugcuggugacccccagcauggccaugcggugcgucggcaucggcucccgcgacuucguggaggggcucagcggcgccaccuggguggacgucgugcuggagcacggguccugcgugacgaccauggccaaggacaagcccacccuggacaucgagcuccugaagaccgaggucacgaaccccgcggugcugcggaagcucugcaucgaggccaagaucagcaacaccaccaccgacucccgcugcccgacgcagggcgaggccacccugguggaggagcaggacgccaacuucgucugccggcgcaccuucguggaccggggcugggggaacggcugcgggcuguucggcaaggggagccucaucacgugcgccaaguucaagugcgugacgaagcuggagggcaagaucguccaguacgagaaccugaaguacuccgugaucgugaccguccacaccggcgaccagcaccagguggggaacgagagcaccgagcacggcacgaccgcgaccaucacgccccaggcccccuccaccgagauccagcucacggacuacggggcccugacccuggacugcagcccccgcaccggccucgacuucaacgagaugguccugcugaccaugaaggagaaguccuggcucgugcacaagcagugguuccuggaccugccgcuccccuggacguccggggccagcaccucccaggagaccuggaaccggcaggaccugcuggugaccuucaagacggcccacgcgaagaagcaggaggucguggugcucggcagccaggagggcgccaugcacaccgcccugaccggggccaccgagauccagacguccggcaccaccaccaucuucgccgggcaccugaagugccgccucaagauggacaagcugacgcugaagggcaugagcuacgucaugugcaccggguccuucaagcucgagaaggagguggcggagacccagcacggcaccgugcugguccagaucaaguacgagggcacggacgcccccugcaagauccccuucagcacccaggacgagaagggggugacccagaacggccggcugaucaccgccaacccgaucgugacggacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacaccgccugggacuucggguccaucggcggcguguucaccagcgucgggaagcuggugcaccagaucuucggcacggccuacggggugcuguucuccggcgucagcuggaccaugaagaucgggaucggcgugcugcugaccuggcucggccugaacucccgcagcaccucccugagcaugacgugcaucgccguggggcucgucacccuguaccugggcgugauggugcaggccgacagcgggugcgucaucaacuggaagggccgggagcucaagugcggguccggcaucuucgugaccaacgaggugcacaccuggacggagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacaccaccuucaucaucgacgggcccaacacgccggagugccccgacgaccagcgcgcguggaacaucugggaggucgaggacuacggcuucgggaucuucaccaccaacaucuggcugaagcugcgggacagcuacacccaggugugcgaccaccgccucauguccgccgccaucaaggacagcaaggccgugcacgccgacaugggcuacuggaucgaguccgagaagaacgagacguggaagcuggcgcgggccagcuucaucgaggucaagaccugcaucuggcccaagucccacacccuguggagcaacggcgugcucgaguccgagaugaucauccccaagaucuacgggggcccgaucagccagcacaacuaccgccccggguacuucacccagacggccggccccuggcaccuggggaagcuggagcucgacuucgaccugugcgagggcaccaccguggucguggacgagcacugcggcaaccgggggccgucccugcgcaccacgaccgugaccggcaagaucauccacgaguggugcugccggagcugcacccugccgccccuccgcuucaagggggaggacggcugcugguacgggauggagauccggcccgucaaggagaaggaggagaaccuggucaagagcaugguguccgccggcagcggcgaggucgacuccuucagccucgggcugcugugcaucuccaucaugaucgaggaggugaugcgcagccgguggucccgcaagaugcucaugacgggcacccuggccguguucuuccugcucaucauggggcagcugaccuggaacgaccugauccggcucugcaucauggucggcgcgaacgccagcgaccgcauggggaugggcaugaccuaccuggcccugauggccacguucaagaugcgcccgauguucgccgugggccuccuguuccggcgccugaccucccgggaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacgcugcugagccucaccuucaucaagaccaccuucucccugcacuacgccuggaagacgauggcgaugguccugagcaucgugucccucuucccccugugccugagcaccaccucccagaagaccacguggcuccccgugcugcugggcagccucgggugcaagccgcugaccauguuccugaucgccgagaacaagaucuggggccgcaagagcuggccccucaacgaggggaucauggccgucggcaucguguccauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgggacgacacccugacgauccuccugaaggccacccugcucgccguguccggcguguacccgcugagcauccccgccacccuguucgucugguacuucuggcagaagaagaagcagcgcuccggggugcucugggacacccccagcccgcccgagguggagcgggccguccuggacgacggcaucuaccgcaucaugcagcggggccugcuggggcgcucccaggugggcgugggggucuuccaggagaacguguuccacaccauguggcacgugacgcggggcgcgguccucauguaccaggggaagcgccuggagcccagcugggccuccgugaagaaggaccugaucagcuacggcggcggguggcggcuccagggcuccuggaacaccggggaggaggugcaggucaucgccguggagcccggcaagaaccccaagaacgugcagaccgcccccgggaccuucaagacgagcgagggcgaggucggcgccaucgcgcuggacuucaagcccgggaccagcggcucccccaucgugaaccgcgaggggaagaucgugggccuguacggcaacggggucgugaccaccagcggcacguacguguccgccaucgcccaggccaaggcgagccaggaggggccccucccggagaucgaggacgaggucuuccggaagcgcaaccugaccaucauggaccugcaccccggcuccgggaagacccggcgcuaccuccccgccaucgugcgggaggccaucaagcgcaagcugcggacccugauccucgccccgacgcgcguggucgccagcgagauggcggaggcccugaagggcaugcccauccgcuaccagaccaccgccgugaaguccgagcacaccggcaaggagaucguggaccugaugugccacgccacguucaccaugcggcuccugagccccguccgcgugcccaacuacaacaugaucaucauggacgaggcccacuucaccgacccguccagcaucgcggcccggggguacaucuccacccgcgugggcaugggggaggccgccgccaucuucaugacggcgacgccgcccggcagcgucgaggccuucccccaguccaacgccgugauccaggacgaggagcgggacaucccggagcgcagcuggaacuccggguacgaguggaucaccgacuuccccggcaagaccgugugguucguccccagcaucaaguccggcaacgacaucgccaacugccugcggaagaacgggaagcgcgugauccagcucagccggaagacguucgacaccgaguaccagaagaccaagaacaacgacugggacuacguggucaccacggacaucuccgagaugggcgcgaacuuccgcgccgaccgggugaucgacccccgccggugccugaagccggugauccugaaggacgggcccgagcgcgucauccucgccggccccaugcccgugaccgucgccagcgccgcgcagcggcgcgggcggaucggccgcaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgggagaaguccgccgcgaucgacggggaguaccgccugcgcggcgaggcccggaagacguucguggagcucaugcgccgcggggaccugccgguguggcuguccuacaaggucgccagcgagggcuuccaguacuccgaccgccgguggugcuucgacggcgagcgcaacaaccaggugcucgaggagaacauggacguggagaucuggaccaaggagggggagcggaagaagcugcgcccccgguggcuggacgcccgcaccuacagcgacccccucgcccugcgggaguucaaggaguucgcggccggccgccgguccgucagcggggaccugauccucgagaucggcaagcugccccagcaccugacccagcgcgcccagaacgcccucgacaaccuggugaugcugcacaacuccgagcagggcgggcgggcguaccgccacgccauggaggagcucccggacacgaucgagacccugaugcugcucgcccugaucgccgugcugaccggcggggucacccucuucuuccugagcggccgggggcugggcaagacguccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugaccguggccgcgaacgagaugggccuccuggagaccaccaagaaggaccuggggaucggccacguggccgucgagaaccaccaccacgccgccaugcucgacguggaccugcaccccgccagcgcguggacgcuguacgccguggccaccaccaucaucacccccaugaugcgccacacgaucgagaacaccaccgccaacaucucccucaccgccaucgcgaaccaggccgccauccugauggggcuggacaagggcuggccgaucagcaagauggacaucggcgucccccuccuggcccuggggugcuacucccaggugaacccccucacgcugaccgcggccgugcugaugcucgucgcccacuacgccaucaucggccccgggcugcaggccaaggcgacccgggaggcccagaagcgcaccgccgccggcaucaugaagaacccgacgguggacgggaucguggccaucgaccuggaccccgucguguacgacgcgaaguucgagaagcagcucggccagaucaugcugcugauccucugcaccagccagauccugcugaugcgcaccaccugggcccucugcgaguccaucacgcuggccaccggcccccugaccacccucugggaggggagccccggcaaguucuggaacacgaccaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcugagcaaguccgaguucaacacguacaagcggagcgggaucauggaggucgaccgcuccgaggcgaaggagggccugaagcgcggggagaccaccaagcacgccgugagccgcggcaccgccaagcuccggugguucguggagcgcaaccuggucaagccggaggggaaggugaucgaccugggcugcggccgcggcgggugguccuacuacugcgccgggcugaagaaggugacggaggucaagggguacaccaagggcggccccggccacgaggagcccauccccauggccaccuacggguggaaccucgugaagcugcacagcggcaaggacguguucuucgucccgcccgagaagugcgacacccugcucugcgacaucggggaguccagccccaaccccacgaucgaggagggccgcacccugcgggugcugaagaugguggagccguggcuccgcgggaaccaguucugcaucaagauccugaaccccuacaugcccuccgucguggagacccuggagcagaugcagcggaagcacggcggcaugcucgugcgcaacccccugagccggaacuccacccacgagauguacugggucagcugcgggacgggcaacaucguguccgcggugaacaugaccagccgcaugcugcucaaccgguucaccauggcccaccgcaagccgaccuacgagcgcgacgucgaccugggggccggcacccggcacguggccguggagcccgaggucgccaaccuggacaucaucggccagcgcaucgagaacaucaagcacgagcacaaguccacguggcacuacgacgaggacaaccccuacaagaccugggcguaccacgggagcuacgaggugaagcccagcggcuccgccagcuccauggucaacgggguggugaagcuccugaccaagccgugggacgucauccccauggugacccagaucgccaugacggacaccacccccuucggccagcagcggguguucaaggagaaggucgacacccgcacgcccaaggccaagcgggggaccgcccagaucauggaggugaccgcgaaguggcuguggggcuuccucagccgcaacaagaagccgcggaucugcacccgcgaggaguucacgcggaaggugcgcuccaacgccgccaucggcgccgucuucguggacgagaaccaguggaacagcgcgaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaaggggucccgggccaucugguacauguggcugggcgcgcgcuuccuggaguucgaggcccucggcuucaugaacgaggaccacugguucagccgggagaacucccugagcgggguggagggcgaggggcugcacaagcucggcuacauccugcgcgacaucuccaagaucagcgggggcaacauguacgccgacgacaccgccggcugggacacccggaucacggaggacgaccugcagaacgaggccaagaucaccgacaucauggagcccgagcacgcgcuccuggccaacuccaucuucaagcugaccuaccagaacaaggucgugcgcgugcagcggcccgccaagaacgggaccgucauggacgugaucagccgccgcgaccagcggggcuccggccaggugggcacguacggccucaacaccuucaccaacauggaggcccagcugauccgccagauggagagcgaggggaucuucuccccgagcgagcuggagacccccaaccucgccgagcggguccuggacuggcuggagaagcacggcguggagcgccucaagcggauggcgaucagcggggacgacugcguggucaagcccaucgacgaccgcuucgccacggcccugaccgcccugaacgacaugggcaaggugcggaaggacaucccccagugggagccguccaagggguggaacgacuggcagcagguccccuucugcagccaccacuuccaccagcucaucaugaaggacggccgcgagaucgucgugcccugccggaaccaggacgagcuggugggccgcgcccgggucucccagggggcgggcuggagccugcgcgagaccgccugccucgggaaguccuacgcccagauguggcagcugauguacuuccaccggcgcgaccugcggcucgccgcgaacgccaucugcagcgccgugcccguggacugggucccgaccucccgcacgaccuggagcauccacgcccaccaccaguggaugaccaccgaggacaugcuguccguguggaaccggguguggaucgaggagaaccccuggauggaggacaagacgcacaucagcuccugggaggacguccccuaccugggcaagcgcgaggaccaguggugcgggagccucaucggccugaccgcccgggcgaccugggccaccaacauccagguggccaucaaccaggugcgccgccugaucggcaacgagaacuaccucgacuacaugacguccaugaagcgguucaagaacgagagcgaccccgagggggcccugugguga

SEQ ID NO: 8044 - RNA, 9879 nt, Artificial Sequence
  derived and/or modified CDS sequence (opt1) from DENV-1__HM181946__SS-prME
agcgugaccaugcugcucaugcugaugcccaccgcccuggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugccccacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagauccgguacgagggcaccgacgcccccugcaagauccccuucagcacccaggacgagcgcggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccgccggauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccuccuucagcaugaccugcaucgccguggggcuggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccucuccgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgucgcgggcauccuggcccaggggaagaagaugauccggccccagcccauggaguacaaguacagcuggcgcuccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcucaagcugcgcgacagcuacacccaggucugcgaccaccggcugauguccgccgccaucaaggacagcaaggccgugcacgccgacaugggcuacuggaucgaguccgagaagaacgagaccuggaagcucgcgcgcgccagcuucaucgaggugaagaccugcaucuggcccaagucccacacgcuguggagcaacggcguccuggaguccgagaugaucauccccaagaucuacgggggcccgaucagccagcacaacuaccggcccggguacuucacccagaccgccggccccuggcaccucgggaagcuggagcuggacuucgaccucugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccuggggcuccugugcaucuccaucaugaucgaggaggucaugcgcagccgcuggucccggaagaugcugaugaccggcacccucgccguguuccugcugcucaucauggggcagcugacguggaacgaccugauccgccucugcaucauggugggcgcgaacgccagcgaccggauggggaugggcaccaccuaccuggcccugauggccaccuucaagaugcgcccgauguucgccgucgggcuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgccgguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgcuaccucccggccaucguccgggaggccaucaagcgcaagcugcggacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgccauggaggagcuccccgacaccaucgagacgcugaugcugcucgcccugaucgccgugcugaccggcggggugacccucuucuuccuguccggccgcgggcugggcaagaccagcaucggccuccugugcgucauggccuccagcgugcugcucuggauggcguccguggagccccacuggaucgccgccagcaucauccuggaguucuuccugaugguccuccugauccccgagccggaccgccagcggacgccccaggacaaccagcuggccuacguggugaucgggcuccuguucaugauccugacggucgccgcgaacgagaugggccuccuggagaccaccaagaaggaccuggggaucggccacguggccguggggaaccaccaccacgccgccaugcucgacgucgaccugcaccccgccuccgcguggacccuguacgccguggccacgaccaucaucaccccgaugaugcgccacaccaucgagaacacgaccgccaacaucagccucaccgccaucgcgaaccaggccgccauccugaugggccuggacaagggcuggcccaucuccaagauggacaucggggugccccuccuggcccugggcugcuacagccaggucaacccccucacccugacggcggccgugcugaugcucguggcccacuacgccaucaucgggccgggccugcaggccaaggcgacccgggaggcccagaagcgcaccgccgccgggaucaugaagaaccccaccgucgacggcaucguggccaucgaccuggaccccguggucuacgacgcgaaguucgagaagcagcucggccagaucaugcugcugauccucugcacgucccagauccugcugaugcggaccaccugggcccucugcgagagcaucacccuggccacggggccccugaccacccucugggagggcuccccggggaaguucuggaacaccacgaucgccgugagcauggccaacaucuuccgcggcuccuaccuggcgggcgccgggcuggccuucagccucaugaagucccugggcgggggccggcgcgggaccggcgcccagggcgagacccugggggagaaguggaagcggcagcucaaccagcuguccaagagcgaguucaacaccuacaagcgcuccggcaucauggagguggaccggagcgaggcgaaggaggggcugaagcgcggcgagacgaccaagcacgccgucucccgggggaccgccaagcuccgcugguucguggagcggaaccuggugaagcccgagggcaaggucaucgaccugggcugcgggcgcggcggguggagcuacuacugcgccggccugaagaaggugaccgaggugaagggguacacgaagggcggccccgggcacgaggagcccaucccgauggccaccuacggcuggaaccucgucaagcugcacuccgggaaggacguguucuucgugccgcccgagaagugcgacacccugcucugcgacaucggcgagagcucccccaacccgaccaucgaggaggggcggacgcugcgcguccugaagaugguggagcccuggcuccggggcaaccaguucugcaucaagauccugaaccccuacaugcccagcguggucgagacccuggagcagaugcagcgcaagcacggcgggaugcucgugcgcaacccgcugucccggaacagcacccacgagauguacuggguguccugcggcaccgggaacaucgucagcgcggugaacaugaccucccgcaugcugcucaaccgguucacgauggcccaccgcaagcccaccuacgagcgggacguggaccugggcgccggcacccgccacgucgccguggagcccgagguggccaaccuggacaucaucgggcagcggaucgagaacaucaagcacgagcacaagagcaccuggcacuacgacgaggacaaccccuacaagacgugggcguaccacggcuccuacgaggucaagccgagcggguccgccagcagcauggugaacggcgucgugaagcuccugaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcgaaguggcuguggggcuuccucucccggaacaagaagccccgcaucugcacccgggaggaguucacccgcaaggugcggagcaacgccgccaucggggccguguucgucgacgagaaccaguggaacuccgcgaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgccaucugguacauguggcugggcgcgcgguuccuggaguucgaggcccucggguucaugaacgaggaccacugguucucccgcgagaacagccuguccggcguggagggggagggccugcacaagcucggguacauccugcgcgacaucagcaagauccccggcggcaacauguacgccgacgacaccgccgggugggacacccggaucaccgaggacgaccugcagaacgaggcccgcaucacggacaucauggagccggagcacgcgcuccuggccaaguccaucuucaagcugaccuaccagaacaaggugguccgggugcagcgccccgccaagaacggcaccgugauggacgucaucagccggcgcgaccagcggggguccggccaggugggcaccuacgggcucaacacguucaccaacauggaggcccagcugauccgccagauggagagcgagggcaucuucucccccagcgagcuggagacccccaaccucgccgagcgggugcuggacuggcuggagaaguacggggucgagcgccucaagcggauggcgaucuccggcgacgacugcguggugaagccgaucgacgaccgcuucgccaccgcccugacggcccugaacgacauggggaagguccggaaggacaucccccagugggagcccagcaagggcuggaacgacuggcagcagguccccuucugcucccaccacuuccaccagcucaucaugaaggacggccgcgagaucguggucccgugccggaaccaggacgagcugguggggcgcgcccgggugagccagggcgcgggguggagccugcgcgagaccgccugccucggcaaguccuacgcccagauguggcagcugauguacuuccaccggcgcgaccugcgccucgccgcgaacgccaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccugggcaagcgggaggaccaguggugcggcagccucaucgggcugacggcccgcgcgaccugggccaccaacauccagguggccaucaaccagguccggcgccugaucggcaacgagaacuaccucgacuacaugaccuccaugaagcgguucaagaacgagagcgaccccgagggggcccugugguga

SEQ ID NO: 8045 - RNA, 9879 nt, Artificial Sequence
  derived and/or modified CDS sequence (opt1) from DENV-1__HM181948__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacacgaugaccuacaagugcccccggaucaccgagguggagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgcguggaagcagauccagcggguggagaccugggcccuccgccaccccggguucacggugaucgcccuguuccuggcccacgcgaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgccauccugcggaagcucugcaucgaggcgaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgccaccaucacgccccaggcgcccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgccaagaagcaggaggucguggugcucggcagccaggagggcgcgaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggccgagacgcagcacggcaccgugcugguccagaucaaguacgagggcaccgacgcgcccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgccggcgagaaggcgcugaagcucagcugguucaagaagggguccagcaucggcaagauguucgaggccaccgcccgcggggcccggcgcauggccauccugggcgacacggcgugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggccgacagcccgaagcgccuguccgcggccaucggcaaggccugggaggagggggucugcggcauccggagcgccacccgccuggagaacaucauguggaagcagaucuccaacgagcucaaccacauccugcuggagaacgacaugaaguucaccgugguggucggggacguggccggcauccucgcgcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguuccugcuccugaucauggggcagcugacguggaacgaccucauccgccugugcaucauggucggcgccaacgcgagcgaccgcauggggaugggcaccaccuaccuggcccucauggccaccuucaagaugcggccgauguucgccguggggcugcuguuccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccaccuucucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcgcacccucauccuggcccccacccggguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgggaaccaccaccacgccgccaugcuggacguggaccugcaccccgccuccgccuggacccucuacgcgguggccacgaccaucaucaccccgaugaugcgccacaccaucgagaacacgaccgccaacaucagccugaccgccaucgccaaccaggcggccauccugaugggccucgacaagggcuggcccaucuccaagauggacaucggggucccccugcuggcccucggcugcuacagccaggugaacccccugacccugacggccgcggugcucaugcuggucgcccacuacgccaucaucgggccgggccugcaggccaaggccacccgcgaggcgcagaagcggaccgccgccgggaucaugaagaaccccaccguggacggcaucguggccaucgaccucgaccccgucguguacgacgccaaguucgagaagcagcugggccagaucaugcugcucauccugugcacgucccagauccugcucaugcgcaccaccugggcgcugugcgagagcaucacccuggccacggggccccucaccacccugugggagggcuccccggggaaguucuggaacaccacgaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggaggucgaccgcagcgaggccaaggaggggcucaagcggggcgagacgaccaagcacgcggugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcgcacgcugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgccgugaacaugaccucccgcaugcuccugaaccgcuucacgauggcgcaccggaagcccaccuacgagcgcgacguggaccugggcgccggcacccggcacgucgccguggagcccgagguggccaaccucgacaucaucgggcagcgcaucgagaacaucaagcacgagcacaagagcaccuggcacuacgacgaggacaaccccuacaagacgugggccuaccacggcuccuacgaggucaagccgagcggguccgcgagcagcauggugaacggcgucgugaagcugcugaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgccaaguggcucuggggcuuccugucccgcaacaagaagccccggaucugcacccgcgaggaguucacccggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgccacgugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccggaucaccgaggacgaccuccagaacgaggcccgcaucacggacaucauggagccggagcacgcccugcuggcgaaguccaucuucaagcucaccuaccagaacaaggugguccgcgugcagcggcccgccaagaacggcaccgugauggacgucaucagccgccgggaccagcgcggguccggccaggugggcaccuacgggcugaacacguucaccaacauggaggcccagcugauccggcagauggagagcgagggcaucuucucccccagcgagcucgagacccccaaccuggccgagcgcgugcuggacuggcucgagaaguacggggucgagcggcugaagcgcauggccaucuccggcgacgacugcguggugaagccgaucgacgaccgguucgcgaccgcccugacggcccucaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcugguggggcgggcccgcgugagccagggcgccggguggagccuccgggagaccgcgugccugggcaaguccuacgcccagauguggcagcugauguacuuccaccgccgggaccuccgccuggccgccaacgcgaucugcagcgccguccccguggacuggauccccaccucccggaccacguggagcauccacgcccaccaccaguggaugaccaccgaggacaugcuguccguguggaaccgcgucuggaucgaggagaaccccuggauggaggacaagacccacaucagcuccuggggcgacgugccguaccucggcaagcgcgaggaccaguggugcggcagccugaucgggcugacggcccgggccaccugggcgaccaacauccagguggccaucaaccagguccgccggcucaucggcaacgagaacuaccuggacuacaugaccuccaugaagcgcuucaagaacgagagcgaccccgagggggcccugugguga

SEQ ID NO: 8046 - RNA, 9879 nt, Artificial Sequence
  derived and/or modified CDS sequence (opt1) from DENV-1__HM181949__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacgggccacgggaccaccgcgaccaucacgccccaggcccccacgaccgagauccagcucaccgacuacggcgcccugacccuggacugcagcccccgcacggggcucgacuucaacgagauggugcugcugaccaugaaggagaaguccuggcucguccacaagcagugguuccuggaccugccccuccccuggaccagcggcgccagcaccucccaggagacguggaaccggcaggaccugcuggugaccuucaagaccgcccacgcgaagaagcaggagguggucgugcucggcagccaggagggggccaugcacaccgcccugacgggcgccaccgagauccagaccuccgggaccacgaccaucuucgccggccaccugaagugccgccucaagauggacaagcugacccugaaggggaugagcuacgugaugugcaccggcuccuucaagcucgagaaggaggucgcggagacgcagcacggcaccgugcuggugcagaucaaguacgaggggaccgacgcccccugcaagauccccuucagcacccaggacgagaagggcgucacgcagaacgggcggcugaucaccgccaacccgaucgugaccgacaaggagaagcccgugaacaucgaggccgagccgcccuucggcgaguccuacaucgucaucggcgcgggggagaaggcccugaagcucagcugguucaagaagggcuccagcaucgggaagauguucgaggccaccgcccgcggcgcccggcgcauggcgauccugggggacacggccugggacuucggcuccaucggcgggguguucaccagcgugggcaagcugguccaccagaucuucgggaccgccuacggcguccucuucuccggggugagcuggaccaugaagaucggcaucggcguccugcugacguggcucgggcugaacucccgcagcaccucccugagcaugaccugcaucgccgugggccucgugacccuguaccugggggucauggugcaggccgacuccggcugcgugaucaacuggaaggggcgggagcucaagugcggcagcggcaucuucgucacgaacgaggugcacaccuggaccgagcaguacaaguuccaggcggacagcccgaagcgccuguccgccgccaucgggaaggccugggaggagggcgugugcgggauccggagcgccacccgccuggagaacaucauguggaagcagaucuccaacgagcucaaccacauccugcuggagaacgacaugaaguucaccgucguggugggcgacgucgcggggauccucgcccagggcaagaagaugauccggccccagcccauggaguacaaguacagcuggaaguccuggggcaaggccaagaucaucggggccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacgggguccucgaguccgagaugaucauccccaagaucuacggcgggccgaucagccagcacaacuaccgccccggcuacuucacccagaccgccgggcccuggcaccugggcaagcuggagcucgacuucgaccugugcgagggcaccacggugguggucgacgagcacugcgggaaccggggcccgucccugcgcaccaccaccgugacggggaagaucauccacgaguggugcugccggagcugcacccugccgccccuccgcuuccggggcgaggacgggugcugguacggcauggagauccgccccgugaaggagaaggaggagaaccuggucaaguccauggugagcgccggcagcggggagguggacuccuucagccucggccugcugugcaucuccaucaugaucgaggaggucaugcggagccgcuggucccggaagaugcucaugaccgggacccuggccguguuccugcuccugaucaugggccagcugacguggaacgaccucauccgccugugcaucauggugggggcgaacgccagcgaccgcaugggcaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucgggagccugggcugcaagccgcugacgauguuccucaucgccgagaacaagaucugggggcggcgcuccuggccccugaacgagggcaucauggccguggggaucgucagcauccugcucagcucccugcugaagaacgacgugccccucgccggcccccugaucgccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgggacgacacccucaccauccugcugaaggccacccuccuggccgucuccgggguguacccgcugagcauccccgccacccucuucgugugguacuucuggcagaagaagaagcagcgcuccggcguccugugggacacccccagcccgcccgagguggagcgggccgugcuggacgacggcaucuaccgcaucaugcagcgggggcugcucggccgcucccaggucggggugggcguguuccaggagaacgucuuccacaccauguggcacgugacccgcggggcggugcugauguaccagggcaagcgccuggagcccagcugggccuccgucaagaaggaccucaucagcuacggcgggggcuggcggcugcagggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgcgagggcaagaucgugggccucuacgggaacggcguggucaccaccagcgggaccuacgugagcgccaucgcccaggccaaggcgucccaggagggcccgcugcccgagaucgaggacgagguguuccggaagcgcaaccugacgaucauggaccuccaccccgggagcggcaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccgggaaggagaucguggaccucaugugccacgccaccuucacgaugcggcugcugucccccgugcgcgucccgaacuacaacaugaucaucauggacgaggcccacuucaccgaccccagcuccaucgcggcccggggcuacaucagcacccgcguggggaugggcgaggccgccgccaucuucaugaccgcgacgccgcccggguccguggaggccuucccgcagagcaacgccgucauccaggacgaggagcgggacauccccgagcgcuccuggaacagcggcuacgaguggaucaccgacuuccccggcaagaccgugugguucgugcccuccaucaagagcgggaacgacaucgccaacugccuccggaagaacggcaagcgcgucauccagcugucccggaagaccuucgacacggaguaccagaagaccaagaacaacgacugggacuacguggugaccaccgacaucagcgagaugggggcgaacuuccgcgccgaccgggucaucgacccgcgccggugccugaagcccgugauccucaaggacggccccgagcgcgugauccuggccgggcccaugccggucacgguggccuccgccgcgcagcggcgcggccggaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgcgagaaguccgccgcgaucgacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggacgaaggagggcgagcggaagaagcugcgcccccgguggcucgacgcccgcaccuacuccgacccccuggcccugcgggaguucaaggaguucgcggccgggcgccggagcguguccggcgaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccgggggcgugacccuguucuuccuguccgggcggggccucggcaagaccagcaucgggcugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccaccaagaaggaccucggcaucgggcacguggccgugggcaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggguggcccaucuccaagauggacaucggcgugccccugcuggcccucgggugcuacagccaggucaacccccugacccugacggcggccgugcucaugcugguggcccacuacgccaucaucggcccggggcugcaggccaaggcgacccgcgaggcccagaagcggaccgccgccggcaucaugaagaaccccaccgucgacggcaucguggccaucgaccucgaccccguggucuacgacgcgaaguucgagaagcagcuggggcagaucaugcugcucauccugugcacgucccagauccugcucaugcgcaccaccugggcccugugcgagagcaucacccuggccacgggcccccucaccacccugugggagggguccccgggcaaguucuggaacaccacgaucgccgugagcauggccaacaucuuccggggcuccuaccuggcgggggccggccucgccuucagccugaugaagucccuggggcgcggccggcgcgggaccggcgcccagggcgagacccucggggagaaguggaagcggcagcugaaccagcuguccaagagcgaguucaacaccuacaagcgcuccggcaucauggagguggaccggagcgaggcgaaggaggggcucaagcgcggcgagacgaccaagcacgccgucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcggacgcugcgcgugcucaagauggucgagcccuggcugcggggcaaccaguucugcaucaagauccugaaccccuacaugcccagcgugguggagacccucgagcagaugcagcgcaagcacggcgggaugcugguccggaacccgcugucccgcaacagcacccacgagauguacuggguguccugcggcaccgggaacaucgugagcgcggucaacaugaccucccgcaugcuccugaaccgguucacgauggcccaccgcaagcccaccuacgagcgggacguggaccugggcgccggcacccgccacguggccgucgagcccgagguggccaaccucgacaucaucgggcagcggaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgcgucuucaaggagaagguggacacccggaccccgaaggccaagcgcggcacggcccagaucauggaggugaccgcgaaguggcucuggggcuuccugucccggaacaagaagccccgcaucugcacccgggaggaguucacccgcaagguccggagcaacgccgccaucggggccguguucguggacgagaaccaguggaacuccgcgaaggaggccgucgaggacgagcgcuucugggaccuggugcaccgggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggcccgcaucacggacaucauggagccggagcacgcgcugcuggccaaguccaucuucaagcucaccuaccagaacaagguggugcggguccagcgccccgccaagaacggcaccgugauggacgugaucagccggcgcgaccagcggggguccggccaggucggcaccuacgggcugaacacguucaccaacauggaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggauccccaccucccgcaccacguggagcauccacgcccaccaccaguggaugaccaccgaggacaugcuguccguguggaaccgcguguggaucgaggagaaccccuggauggaggacaagacccacaucagcuccuggggcgacgucccguaccucggcaagcgggaggaccaguggugcggcagccugaucgggcugacggcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 8047 - RNA, 9879 nt, Artificial Sequence
  derived and/or modified CDS sequence (opt1) from DENV-1__HM181950__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcgccgccuacgggguccucuucuccggcgugagcuggaccaugaagaucgggaucggcguccugcugaccuggcucggccugaacucccgcagcacgucccugagcaugaccugcaucgccguggggcucgugacccuguaccugggcgucauggugcaggcggacuccgggugcgugaucaacuggaagggccgggagcucaagugcgggagcggcaucuucgucaccaacgaggugcacacguggaccgagcaguacaaguuccaggccgacagcccgaagcgccuguccgccgccaucggcaaggccugggaggagggggugugcggcauccggagcgcgacccgccuggagaacaucauguggaagcagaucuccaacgagcucaaccacauccugcuggagaacgacaugaaguucaccgucguggugggggacgucgccggcauccucgcccaggggaagaagaugauccggccccagcccauggaguacaaguacagcuggaaguccuggggcaaggccaagaucaucggcgcggacgugcagaacaccacguucaucaucgacgggcccaacaccccggagugccccgacgaccagcgcgccuggaacaucugggagguggaggacuacggcuucgggaucuucaccaccaacaucuggcugaagcugcgggacagcuacacgcaggucugcgaccaccgccucauguccgccgccaucaaggacagcaaggccgugcacgcggacaugggcuacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggcgguguuccugcuccugaucauggggcagcugaccuggaacgaccucauccgccugugcaucauggugggcgccaacgccagcgaccgcauggggaugggcacgaccuaccuggcccucauggccaccuucaagaugcggccgauguucgcggucgggcugcuguuccgccggcucaccucccgcgaggugcugcugcucacgaucgggcugagccugguggccuccgucgagcuccccaacagccuggaggagcugggcgacgggcucgccaugggcaucaugauccugaagcugcucaccgacuuccagucccaccagcugugggccacccugcucagccugaccuucaucaagacgaccuucucccugcacuacgcguggaagaccauggccauggugcucagcaucgucucccuguucccccugugccucagcaccacgucccagaagaccaccuggcugcccgugcugcucggcagccuggggugcaagccgcugaccauguuccucaucgccgagaacaagaucuggggccggcgcuccuggccccugaacgaggggaucauggccgugggcaucgucagcauccugcucagcucccugcugaagaacgacgugccccucgccgggccccugaucgcgggcggcaugcugaucgccugcuacgugaucagcggguccagcgccgaccucucccuggagaaggccgccgaggucagcugggaggaggaggcggagcacuccggcgccagccacaacauccugguggaggugcaggacgacgggacgaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacgcccagcccgcccgagguggagcgggcggugcuggacgacggcaucuaccgcaucaugcagcggggccugcucgggcgcucccaggucggcguggggguguuccaggagaacgucuuccacaccauguggcacgugacccggggcgccgugcugauguaccaggggaagcgccuggagcccagcugggccuccgucaagaaggaccucaucagcuacggcggcggguggcggcugcagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgcgaggggaagaucgugggccucuacggcaacgggguggucacgaccagcggcaccuacgugagcgccaucgcccaggcgaaggccucccaggaggggccgcugcccgagaucgaggacgagguguuccggaagcgcaaccugaccaucauggaccuccaccccggcagcgggaagacgcggcgcuaccugccggccaucguccgggaggccaucaagcgcaagcugcgcacccucauccuggcccccacccgggugguggcguccgagauggccgaggcccugaagggcaugcccauccgcuaccagaccacggccgucaagagcgagcacaccggcaaggagaucguggaccucaugugccacgccaccuucaccaugcggcugcugucccccgugcgcgucccgaacuacaacaugaucaucauggacgaggcgcacuucacggaccccagcuccaucgccgcccggggguacaucagcacccgcgugggcaugggggaggccgccgcgaucuucaugaccgccacgccgcccggcuccguggaggccuucccgcagagcaacgccgucauccaggacgaggagcgggacauccccgagcgcuccuggaacagcggguacgaguggaucacggacuuccccggcaagaccgugugguucgugcccuccaucaagagcggcaacgacaucgcgaacugccuccggaagaacgggaagcgcgucauccagcugucccggaagaccuucgacaccgaguaccagaagacgaagaacaacgacugggacuacguggugaccaccgacaucagcgagaugggcgccaacuuccgcgccgaccgggucaucgacccgcgccggugccugaagcccgugauccucaaggacgggcccgagcgcgugauccuggccggccccaugccggucaccguggccuccgcggcccagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggaccaaggagggggagcggaagaagcugcgcccccgguggcucgacgcccgcacguacuccgacccccuggcgcugcgggaguucaaggaguucgccgccggccgccggagcguguccggggaccucauccuggagaucggcaagcugccgcagcaccucacccagcgcgcccagaacgcgcuggacaaccuggucaugcuccacaacagcgagcagggcgggcgggccuaccgccacgccauggaggagcugcccgacaccaucgagacccugaugcuccuggcccugaucgccgugcucacgggcggggugacccuguucuuccuguccggccgggggcucggcaagaccagcaucggccugcugugcgucauggcguccagcgugcuccuguggauggccuccguggagccccacuggaucgccgccagcaucauccuggaguucuuccucaugguccugcugauccccgagccggaccgccagcggacgccccaggacaaccagcucgccuacguggugaucgggcugcuguucaugauccucaccgucgcggccaacgagaugggccugcuggagacgaccaagaaggaccucgggaucggccacguggccguggggaaccaccaccacgccgccaugcuggacgucgaccugcaccccgcguccgccuggacccucuacgccguggccaccacgaucaucaccccgaugaugcgccacaccaucgagaacaccacggccaacaucagccugaccgcgaucgccaaccaggccgccauccugaugggccucgacaagggcuggcccaucuccaagauggacaucggggugccccugcuggcgcucggcugcuacagccaggucaacccccugacccugaccgccgccgugcucaugcugguggcccacuacgccaucaucgggccgggccugcaggcgaaggccacgcgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggcgaacaucuuccggggcuccuaccuggccggcgccgggcucgccuucagccugaugaagucccugggcgggggccgccgggggacgggcgcgcagggcgagacccucggggagaaguggaagcgccagcugaaccagcuguccaagagcgaguucaacaccuacaagcgguccggcaucauggagguggaccgcagcgaggccaaggaggggcucaagcggggcgagaccacgaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagcccaucccgauggcgacguacggcuggaaccuggucaagcugcacuccgggaaggacguguucuucaucccgcccgagaagugcgacacccuccugugcgacaucggcgagagcucccccaacccgaccaucgaggaggggcgcacccugcgggugcucaagauggucgagcccuggcugcgcggcaaccaguucugcaucaagauccugaaccccuacaugcccagcgugguggagacgcucgagcagaugcagcggaagcacggcgggaugcugguccgcaacccgcugucccggaacagcacccacgagauguacuggguguccugcggcaccgggaacaucgugagcgccgucaacaugaccucccgcaugcuccugaaccgcuucaccauggcccaccggaagcccacguacgagcgcgacguggaccugggcgccggcacccggcacguggccgucgagcccgagguggcgaaccucgacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugacgaagcccugggacgugauccccauggugacccagaucgccaugaccgacaccacgcccuucgggcagcagcgggucuucaaggagaagguggacacccgcaccccgaaggccaagcggggcaccgcgcagaucauggaggugacggccaaguggcucuggggcuuccugucccgcaacaagaagccccggaucugcacccgcgaggaguucacccggaagguccgcagcaacgccgccaucggggcgguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacacggccgggugggacacccggaucaccgaggacgaccuccagaacgaggcgcgcaucaccgacaucauggagccggagcacgcccugcuggccaaguccaucuucaagcucacguaccagaacaagguggugcgcguccagcggcccgccaagaacggcaccgugauggacgugaucagccgccgggaccagcgcggguccggccaggucggcaccuacagccugaacaccuucacgaacauggaggcccagcugauccggcagauggaguccgaggggaucuucagccccuccgagcucgagacccccaaccuggcggagcgcgugcuggacuggcucgagaaguacggcguggagcggcugaagcgcauggccaucagcggggacgacugcgucgugaagccgaucgacgaccgguucgccaccgcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcgcgcgugagccagggggccggcuggucccuccgggagacggccugccugggcaagagcuacgcccagauguggcagcugauguacuuccaccgccgggaccuccgccuggcggccaacgccaucugcuccgccgugcccgucgacuggauccccaccagccggaccaccugguccauccacgcccaccaccaguggaugacgaccgaggacaugcugagcguguggaaccgcguguggaucgaggagaaccccuggauggaggacaagacccacaucuccagcuggggcgacgucccguaccucgggaagcgcgaggaccaguggugcggcucccugaucggccugaccgcgcgggccacgugggccaccaacauccagguggccaucaaccaggugcgccggcucaucgggaacgagaacuaccuggacuacaugaccagcaugaagcgcuucaagaacgaguccgaccccgagggcgcccugugguga

SEQ ID NO: 8048 - RNA, 9879 nt, Artificial Sequence
  derived and/or modified CDS sequence (opt1) from DENV-1__HM181952__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggucaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggugcaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgccuggaacaucugggagguggaggacuacggcuucgggaucuucaccaccaacaucuggcugaagcuccgggacuccuacacccaggugugcgaccaccgccugaugagcgcggccaucaaggacuccaaggccguccacgccgacaugggcuacuggaucgagagcgagaagaacgagaccuggaagcuggccaaggcguccuucaucgaggugaagaccugcaucuggcccaagagccacacccucugguccaacggcgugcuggagagcgagaugaucauccccaagauccacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugaaguccauggucagcgccggcuccggcgagguggacagcuucucccuggggcugcucugcaucagcaucaugaucgaggaggugaugcgcucccgguggagccgcaagaugcugaugaccggcacccuggccgucuucuuccuccugaucauggggcagcugaccuggaacgaccucauccggcugugcaucauggugggcgccaacgcguccgaccgcauggggaugggcacgaccuaccuggcccucauggccaccuucaagaugcgcccgauguucgccguggggcugcuguuccggcgccucaccagccgggagguccugcugcucacgaucgggcugucccugguggccagcgucgagcuccccaacucccuggaggagcugggcgacgggcucgcgaugggcaucaugauccugaagcugcucaccgacuuccagagcuaccagcugugggccacccugcucucccugaccuucaucaagacgaccuucagccugcacuacgccuggaagaccauggccauggugcucuccaucgugagccuguucccccugugccucuccaccacgagccagaagaccaccuggcugcccguccugcucggcucccuggggugcaagccgcugaccauguuccucaucgcggagaacaagaucuggggccgcaagagcuggccccugaacgaggggaucauggccgugggcaucgugagcauccugcucuccagccugcugaagaacgacgucccccucgccgggccccugaucgccggcggcaugcugaucgccugcuacgugaucuccgggagcuccgcggaccucagccuggagaaggccgccgagguguccugggaggaggaggccgagcacagcggcgccucccacaacauccuggucgaggugcaggacgacgggacgaugaagaucaaggacgaggagcgggacgacacccucaccauccugcugaaggcgacccuccuggccgugagcggcgucuacccgcuguccauccccgccacccucuucguguggcacuucuggcagaagaagaagcagcgcagcggggugcugugggacacgcccagcccgcccgaggucgagcgggccgugcuggacgacggcaucuaccgcaucaugcagcggggccugcucgggcgcagccaggugggcgucgggguguuccaggagaacguguuccacaccauguggcacgucacccggggcgccgugcugauguaccaggggaagcgccuggagcccuccugggcgagcgugaagaaggaccucaucuccuacggcggcggguggcggcugcagggcagcuggaacaccggggaggagguccaggugaucgccguggagcccggcaagaaccccaagaacguccagacggcccccgggaccuucaagacccccgagggcgaggugggcgccaucgcccuggacuucaagcccgggaccuccggcagccccaucgugaaccgcgaggggaagaucgucggccucuacggcaacgggguggugacgaccagcggcaccuacgucuccgcgaucgcccaggccaaggccagccaggaggggccgcugcccgagaucgaggacgagguguuccggaagcgcaaccugaccaucauggaccuccaccccggcuccgggaagacgcggcgcuaccugccggcgaucgugcgggaggccaucaagcgcaagcugcggacccucauccuggcccccacccgcgucguggccagcgagauggccgaggcgcugaagggcaugcccauccgcuaccagaccacggccgugaaguccgagcacaccggcaaggagaucgucgaccucaugugccacgccaccuucaccaugcggcugcugagccccgugcgcgugccgaacuacaacaugaucaucauggacgaggcccacuucacggaccccuccagcaucgccgcgcggggguacaucuccacccgcgucggcaugggggaggccgccgccaucuucaugaccgccacgccgcccggcagcauggaggcguucccgcaguccaacgccgugauccaggacgaggagcgggacauccccgagcgcagcuggaacuccggguacgaguggaucacggacuuccccggcaagaccgugugguucguccccagcaucaaggccggcaacgacaucgccaacugccuccggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccgcgccggugccugaagcccgugauccucaaggacgggcccgagcgcgucauccuggccggccccaugccggugaccgucgccuccgccgcgcagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgggagaaguccgccgcgaucgacggggaguaccgccuccgcggcgaggcccggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcccgcacguacuccgacccccuggcccugcgggaguucaaggaguucgcggccggccgccggagcgucuccggggaccucauccuggagaucggcaagcugccgcagcaccucacccagcgcgcccagaacgcccuggacaaccuggugaugcuccacaacagcgagcagggcgggcgggcguaccgccacgccauggaggagcugcccgacaccaucgagacccugaugcuccuggcccugaucgccgugcucacgggcggggucacccuguucuuccuguccggcaaggggcucggcaagaccagcaucggccugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucgggcugcuguucaugauccucaccguggccgcgaacgagaugggccugcuggagacgaccaagaaggaccucgggaucggccacguggccgucgagaaccaccaccacgccgccaugcuggacguggaccugcaccccgccuccgcguggacccucuacgccguggccaccacgaucaucaccccgaugaugcggcacaccaucgagaacaccacggccaacaucagccugaccgccaucgcgaaccaggccgccauccugauggggcucgacaagggcuggcccaucuccaagauggacaucggcgucccccugcuggcccucgggugcuacagccaggugaacccccugacccugaccgcggccgugcucaugcuggucgcccacuacgccaucgugggcccggggcugcaggccaaggcgacgcgcgaggcccagaagcggaccgccgccggcaucaugaagaaccccaccaucgacgggaucguggccaucgaccucgaccccgucguguacgacgcgaaguucgagaagcagcugggccagaucaugcugcucauccugugcaccucccagauccugcucaugcgcacgaccugggcccugugcgagagcaucacccuggccaccggcccccucacgacccugugggagggguccccgggcaaguucuggaacaccaccaucgccgugagcauggccaacaucuuccgcggguccuaccuggcgggcgccggccucgccuucagccugaugaagucccucgggggcgggcggcgcgggacgggggcccagggcgagacccucggcgagaaguggaagcggcagcugaaccagcuguccaagagcgaguucaacaccuacaagcgcuccgggaucauggaggucgaccggagcgaggcgaaggagggccucaagcgcggggagaccacgaagcacgccgugucccggggcaccgccaagcugcgcugguucguggagcggaaccuggucaagcccgaggggaaggugaucgaccugggcugcggccgcgggggcuggagcuacuacugcgccgggcucaagaaggugaccgaggucaagggcuacaccaagggcgggcccggccacgaggagcccaucccgauggccacguacggguggaaccuggugaagcugcacuccggcaaggacguguucuucaucccgcccgagaagugcgacacccuccugugcgacaucggggagagcucccccaacccgaccaucgaggagggccggacccugcgcguccucaagaugguggagcccuggcugcgggggaaccaguucugcaucaagauccugaaccccuacaugcccagcguggucgagacgcucgagcagaugcagcgcaagcacggcggcaugcuggugcggaacccgcugucccgcaacagcacccacgagauguacuggguguccugcgggaccggcaacaucgucagcgcggugaacaugaccucccggaugcuccugaaccgcuucaccauggcccaccggaagcccacguacgagcgcgacguggaccugggggccggcacccgccacgucgccguggagcccgagguggccaaccucgacaucaucggccagcggaucgagaacaucaagcacgagcacaagagcaccuggcacuacgacgaggacaaccccuacaagaccugggcguaccacggguccuacgaggucaagccgagcggcuccgccagcagcauggugaacggggucgugaagcugcugacgaagcccugggacgugauccccauggucacccagaucgccaugaccgacaccacgcccuucggccagcagcgcguguucaaggagaagguggacacccggaccccgaaggccaagcgcgggaccgcccagaucauggaggucacggcgcgguggcucuggggcuuccugucccgcaacaagaagccccggaucugcacccgcgaggaguucacccggaaggugcgcagcaacgccgccaucggcgccguguucgucgacgagaaccaguggaacuccgcgaaggaggccguggaggacgaccgguucugggaccuggugcaccgcgagcgggagcuccacaagcaggggaagugcgcgaccugcgucuacaacaugaugggcaagcgcgagaagaagcugggggaguucggcaaggccaaggggagccgggccaucugguacauguggcugggcgcgcgcuuccucgaguucgaggcccugggcuucaugaacgaggaccacugguucucccgggagaacagccuguccgggguggagggcgaggggcuccacaagcugggcuacauccugcgcgacaucagcaagauccccgggggcaacauguacgccgacgacacggccggcugggacacccggaucaccgaggacgaccuccagaacgaggccaagaucaccgacaucauggagccggagcacgcgcugcuggccaaguccaucuucaagcucacguaccagaacaaggugguccgcgugcagcggcccgccaagaacgggaccgugauggacgucaucagccgccgcgaccagcggggcuccggccaggugggcaccuacggccugaacaccuucacgaacauggaggcccagcugauccgccagauggagagcgaggggaucuuccuccccaacgagcuggagacccccaaccuggccgagcgggugcucgacuggcuggagaaguacggcgucgagcgccugaagcggauggcgaucuccggggacgacugcguggugaagccgaucgacgaccgcuucgccaccgcccucaccgcccugaacgacaugggcaagguccggaaggacaucccccagugggagcccagcaagggguggaacgacuggcagcagguccccuucugcucccaccacuuccaccagcugaucaugaaggacggccgcgagaucguggucccgugccggaaccaggacgagcucgugggccgcgcccgggugagccagggggcgggcuggucccugcgcgagacggccugccugggcaagagcuacgcccagauguggcagcucauguacuuccaccggcgcgaccugcggcuggccgcgaacgccaucugcagcgccguccccguggacugggugcccaccucccgcaccaccuggagcauccacgcccaccaccaguggaugacgaccgaggacaugcucuccgucuggaaccggguguggaucgaggagaaccccuggauggaggacaagacccgcaucagcuccugggaggacgugccguaccugggcaagcgggaggaccaguggugcgggagccugaucggccucaccgcccgcgcgacgugggccaccaacauccaggucgccaucaaccaggugcgccggcugaucggcaacgagaacuacuccgacuacaugaccagcaugaagcgcuucaagaacgaguccgagcccgagggggcccugugguga

SEQ ID NO: 8049 - RNA, 9879 nt, Artificial Sequence
  derived and/or modified CDS sequence (opt1) from DENV-1__HM181953__SS-prME
agcgugaccaugcugcucaugcugaugcccaccgcgcuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgugcaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgccuggaacaucugggaggucgaggacuacggcuucgggaucuucaccacgaacaucuggcugaagcugcgggacagcuacacccaggugugcgaccaccgccucauguccgcggccaucaaggacagcaaggccgugcacgccgacaugggcuacuggaucgaguccgagaagaacgagaccuggaagcuggcccgggcgagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguuccugcuccugaucauggggcagcugacguggaacgaccucauccgccugugcaucauggucggcgccaacgcgagcgaccgcauggggaugggcaccaccuaccuggcccucauggccaccuucaagaugcggccgauguucgccguggggcugcuguuccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccaccuucucccugcacuacgccuggaagaccauggccaugguccucagcaucgugucccuguucccccugugccucagcacgaccucccagaagaccaccuggcugcccgugcugcucggcagccuggggugcaagccgcugacgauguuccucaucgcggagaacaagaucuggggccggcgcuccuggccccugaacgaggggaucauggccgucggcaucgugagcauccugcucagcucccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcgccagccacaacauccugguggagguccaggacgacgggaccaugaagaucaaggacgaggagcgggacgacacccucaccauccugcugaaggcgacccuccuggccguguccggcguguacccgcugagcauccccgccacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacaccauguggcacgugacccggggcgccguccugauguaccaggggaagcgccuggagcccagcugggcguccgugaagaaggaccucaucagcuacggcggcggguggcggcugcagggcuccuggaacacgggggaggaggugcaggucaucgccguggagcccggcaagaaccccaagaacgugcagaccgcccccgggaccuucaagacccccgagggcgaggucggcgccaucgcccuggacuucaagcccgggacgagcggcucccccaucgugaaccgcgaggggaagaucgugggccucuacggcaacggggucgugaccaccagcggcaccuacgugagcgcgaucgcccaggccaaggccucccaggaggggccgcugcccgagaucgaggacgaggucuuccggaagcgcaaccugacgaucauggaccuccaccccggcagcgggaagacccggcgcuaccugccggcgaucgugcgggaggccaucaagcgcaagcugcgcacccucauccuggcccccacccggguggucgccuccgagauggccgaggcgcugaagggcaugcccauccgcuaccagacgaccgccgucaagagcgagcacaccggcaaggagaucguggaccucaugugccacgccaccuucacgaugcggcugcugucccccguccgcgugccgaacuacaacaugaucaucauggacgaggcccacuucaccgaccccagcuccaucgccgcgcggggguacaucagcacccgcgugggcaugggggaggccgccgccaucuucaugaccgccacgccgcccggcuccgucgaggcguucccgcagagcaacgccgugauccaggacgaggagcgggacauccccgagcgcuccuggaacagcggguacgaguggaucaccgacuuccccggcaagaccgugugguucguccccuccaucaagagcggcaacgacaucgccaacugccuccggaagaacgggaagcgcgugauccagcugucccggaagaccuucgacacggaguaccagaagaccaagaacaacgacugggacuacguggucaccaccgacaucagcgagaugggcgccaacuuccgcgcggaccgggugaucgacccgcgccggugccugaagcccgugauccucaaggacgggcccgagcgcgucauccuggccggccccaugccggugacggucgccuccgccgcccagcggcgcgggcggaucggccgcaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccggcuccgcggcgaggcgcggaagaccuucguggagcugaugcgccgcggggaccugcccguguggcucuccuacaaggucgccagcgagggcuuccaguacagcgaccgccgguggugcuucgacggcgagcgcaacaaccaggugcuggaggagaacauggacguggagaucuggacgaaggagggggagcggaagaagcugcgcccccgguggcucgacgcccgcaccuacuccgacccccuggcccugcgggaguucaaggaguucgccgcgggccgccggagcgucuccggggaccucauccuggagaucggcaagcugccgcagcaccucacccagcgcgcccagaacgcccuggacaaccuggugaugcuccacaacagcgagcagggcgggcgggccuaccgccacgcgauggaggagcugcccgacaccaucgagacgcugaugcuccuggcccugaucgccgugcucaccggcggggucacccuguucuuccuguccggccgggggcucggcaagaccagcaucggccugcugugcgugauggccuccagcgugcuccuguggauggccuccgucgagccccacuggaucgcggccagcaucauccuggaguucuuccucauggugcugcugauccccgagccggaccgccagcggacgccccaggacaaccagcucgccuacguggucaucgggcugcuguucaugauccucacgguggccgccaacgagaugggccugcuggagaccaccaagaaggaccucgggaucggccacguggcggucgggaaccaccaccacgccgccaugcuggacguggaccugcaccccgccuccgccuggacccucuacgcgguggccacgaccaucaucaccccgaugaugcgccacaccaucgagaacacgaccgccaacaucagccugaccgccaucgccaaccaggcggccauccugaugggccucgacaagggcuggcccaucuccaagauggacaucggggucccccugcuggcccucggcugcuacagccaggugaacccccugacccugacggccgcggugcucaugcuggucgcccacuacgccaucaucgggccgggccugcaggccaaggccacccgcgaggcgcagaagcggaccgccgccgggaucaugaagaaccccaccguggacggcaucguggccaucgaccucgaccccgucguguacgacgccaaguucgagaagcagcugggccagaucaugcugcucauccugugcacgucccagauccugcucaugcgcaccaccugggcgcugugcgagagcaucacccuggccacggggccccucaccacccugugggagggcuccccggggaaguucuggaacaccacgaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcuguccaagcucgaguucaacaccuacaagcggagcggcaucauggaggucgaccgcuccgaggccaaggaggggcugaagcggggcgagacgaccaagcacgcggugagccgcgggaccgccaagcugcggugguucguggagcgcaaccuggucaagcccgagggcaaggugaucgaccucggcugcgggcggggcgggugguccuacuacugcgccggccugaagaaggugaccgaggucaagggguacacgaagggcggccccgggcacgaggagcccaucccgauggccaccuacggcuggaaccuggugaagcuccacagcgggaaggacguguucuucaucccgcccgagaagugcgacacccugcugugcgacaucggcgaguccagccccaacccgaccaucgaggaggggcgcacgcuccggguccugaagaugguggagcccuggcugcgcggcaaccaguucugcaucaagauccucaaccccuacaugcccuccguggucgagacccuggagcagaugcagcggaagcacggcgggaugcuggugcgcaacccgcucagccggaacuccacccacgagauguacugggugagcugcggcaccgggaacaucgucuccgccgugaacaugaccagccgcaugcugcugaaccgcuucacgauggcgcaccggaagcccaccuacgagcgcgacguggaccucggcgccggcacccggcacgucgccguggagcccgagguggccaaccuggacaucaucgggcagcgcaucgagaacaucaagcacgagcacaaguccaccuggcacuacgacgaggacaaccccuacaagacgugggccuaccacggcagcuacgaggucaagccguccgggagcgcguccagcauggugaacggcgucgugaagcugcucaccaagcccugggacgugauccccauggucacccagaucgccaugaccgacacgacccccuucgggcagcagcggguguucaaggagaagguggacacccgcaccccgaaggccaagcggggcacggcccagaucauggaggucaccgccaaguggcuguggggcuuccugagccgcaacaagaagccccggaucugcacccgcgaggaguucacccggaaggugcgcuccaacgcggccaucggggccguguucgucgacgagaaccaguggaacagcgccaaggaggcgguggaggacgagcgguucugggaccucgugcaccgcgagcgggagcugcacaagcagggcaagugcgccacgugcgucuacaacaugauggggaagcgcgagaagaagcugggcgaguucgggaaggccaagggcucccgggccaucugguacauguggcucggcgcccgcuuccuggaguucgaggcgcugggguucaugaacgaggaccacugguucagccgggagaacucccucagcggcguggagggggagggccugcacaagcugggguacauccuccgcgacaucuccaagauccccggcggcaacauguacgccgacgacaccgccgggugggacacccggaucaccgaggacgaccugcagaacgaggcccgcaucacggacaucauggagccggagcacgcccugcucgccaagagcaucuucaagcugaccuaccagaacaaggugguccgcgugcagcggcccgccaagaacggcaccgugauggacgucaucucccgccgggaccagcgcgggagcggccaggugggcaccuacgggcugaacacguucaccaacauggaggcccagcucauccggcagauggaguccgagggcaucuucagccccuccgagcuggagacccccaaccuggccgagcgcgugcucgacuggcuggagaaguacggggucgagcggcugaagcgcauggccaucagcggcgacgacugcguggugaagccgaucgacgaccgguucgcgaccgcccucacggcccugaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcucguggggcgggcccgcgugucccagggcgccggguggagccugcgggagaccgcgugccugggcaagagcuacgcccagauguggcagcucauguacuuccaccgccgggaccugcgccuggccgccaacgcgaucugcuccgccguccccguggacuggauccccaccagccggaccacgugguccauccacgcccaccaccaguggaugaccaccgaggacaugcucagcguguggaaccgcgucuggaucgaggagaaccccuggauggaggacaagacccacaucuccagcuggggcgacgugccguaccugggcaagcgcgaggaccaguggugcggcucccugaucgggcucacggcccgggccaccugggcgaccaacauccagguggccaucaaccagguccgccggcugaucggcaacgagaacuaccuggacuacaugaccagcaugaagcgcuucaagaacgaguccgaccccgagggggcccucugguga

SEQ ID NO: 8050 - RNA, 9879 nt, Artificial Sequence
  derived and/or modified CDS sequence (opt1) from DENV-1__KF921933__SS-prME
agcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagcaagugcccgacccagggcgaggccacccugguggaggagcaggacgccaacuucgugugccgccggaccuucgucgaccgcggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucaccccccaggcccccacgaccgagauccagcucaccgacuacggggcccugacccuggacugcagcccccggacgggccucgacuucaacgagauggugcugcugaccaugaaggagaaguccuggcucguccacaagcagugguuccuggaccugccgcuccccuggaccagcggggccagcaccucccaggagacguggaaccgccaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccggcucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccgccugaucaccgccaacccgaucgugaccgacaaggagaagcccgugaacaucgaggccgagccccccuucggggaguccuacaucgucaucggcgcgggcgagaaggcccugaagcucagcugguucaagaagggguccagcaucggcaagauguucgaggccaccgcccggggggcccgccggauggcgauccugggcgacacggccugggacuucggguccaucggcggcguguucaccagcguggggaagcugguccaccagaucuucggcaccgccuacggggugcucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucaccgucguggugggggacgucgcgggcauccucgcccaggggaagaagaugauccgcccccagcccauggaguacaaguacagcuggaaguccuggggcaaggccaagaucaucggcgccgacgugcagaacacgaccuucaucaucgacgggcccaacaccccggagugccccgacgaccagcgggcguggaacaucugggagguggaggacuacggcuucgggaucuucaccacgaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcuguggagcaacggcguccucgaguccgagaugaucauccccaagaucuacgggggcccgaucagccagcacaacuaccggcugggguacuucacccagaccgccggccccuggcaccuggggaagcucgagcuggacuucgaccugugcgagggcaccacggugguggucgacgagcacugcggcaaccgcgggcccucccuccggaccaccaccgugacgggcaagaucauccacgaguggugcugccgcagcugcacccugccgccccugcgguuccgcggggaggacggcugcugguacgggauggagauccggcccgugaaggagaaggaggagaaccucgucaaguccauggugagcgccggcagcggcgagguggacuccuucagccuggggcugcucugcaucuccaucaugaucgaggaggucaugcgcagccgguggucccgcaagaugcugaugaccggcacccuggccguguuccuccugcugaucauggggcagcucacguggaacgaccugauccggcugugcaucauggugggcgcgaacgccagcgaccgcauggggaugggcaccaccuaccucgcccugauggccaccuucaagaugcgccccauguucgccgucggccugcucuuccggcgccugacgucccgggaggugcugcuccugaccaucgggcugagccucguggcguccgucgagcugccgaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgauggugcugagcaucgucucccuguucccccucugccugagcacgaccucccagaagaccaccuggcugcccgugcuccugggcagccuggggugcaagccccucacgauguuccugaucgccgagaacaagaucuggggccgccgguccuggccgcugaacgaggggaucauggccgugggcaucgucagcauccuccugagcucccugcucaagaacgacgugccccuggccgggccccugaucgccggcggcaugcucaucgcgugcuacgugaucagcggguccagcgccgaccugucccuggagaaggccgccgaggucagcugggaggaggaggccgagcacuccggcgcgagccacaacauccucguggaggugcaggacgacgggaccaugaagaucaaggacgaggagcgcgacgacacccugaccauccugcucaaggccacccugcuggccgucuccggcguguacccccucagcaucccggccacgcuguucgugugguacuucuggcagaagaagaagcagcgguccgggguccugugggacacccccagcccccccgagguggagcgcgccgugcuggacgacggcaucuaccggaucaugcagcgcggccuccuggggcggucccaggucggcguggggguguuccaggagaacgucuuccacaccauguggcacgugacccgcggcgcggugcugauguaccaggggaagcggcucgagccgagcugggccuccgucaagaaggaccugaucagcuacggcggcggguggcgccugcagggcuccuggaacacgggggaggaggugcaggugaucgccgucgagcccggcaagaaccccaagaacgugcagaccgcccccgggaccuucaagaccccggagggcgaggugggcgccaucgcgcucgacuucaagcccgggacgagcggcucccccaucgucaaccgggaggggaagaucgugggccuguacggcaacgggguggucaccaccagcggcaccuacgugagcgccaucgcccaggccaaggcgucccaggaggggccccugccggagaucgaggacgagguguuccgcaagcggaaccucacgaucauggaccugcaccccggcagcgggaagacccgccgguaccugcccgccaucguccgcgaggccaucaagcggaagcuccgcacccugauccuggccccgacccgcgugguggccuccgagauggcggaggcccucaagggcaugcccauccgguaccagacgaccgccgucaagagcgagcacaccggcaaggagaucguggaccugaugugccacgccaccuucacgaugcgccugcucucccccgugcggguccccaacuacaacaugaucaucauggacgaggcccacuucaccgacccgagcuccaucgcggcccgcggguacaucagcacccgggugggcaugggggaggccgccgccaucuucaugaccgcgacgccccccggcuccguggaggccuucccccagagcaacgccgucauccaggacgaggagcgcgacaucccggagcgguccuggaacagcggguacgaguggaucaccgacuuccccggcaagaccgugugguucgugcccuccaucaagagcggcaacgacaucgccaacugccugcgcaagaacgggaagcgggucauccagcugucccgcaagaccuucgacacggaguaccagaagaccaagaacaacgacugggacuacguggugaccaccgacaucagcgagaugggcgcgaacuuccgggccgaccgcgucaucgacccccggcgcugccucaagccggugauccugaaggacgggcccgagcgggugauccuggccggccccaugcccgucacgguggccuccgccgcgcagcgccgggggcgcaucggccggaaccacaacaaggagggcgaccaguacaucuacauggggcagccgcucaacaacgacgaggaccacgcccacuggaccgaggccaagaugcugcuggacaacaucaacacccccgagggcaucauccccgcccucuucgagcccgagcgcgagaagagcgccgcgaucgacggggaguaccgccugcggggcgaggcccgcaagaccuucgucgagcugaugcggcgcggggaccucccgguguggcuguccuacaagguggccagcgagggcuuccaguacagcgaccggcgcuggugcuucgacggcgagcggaacaaccagguccuggaggagaacauggacguggagaucuggacgaaggagggggagcgcaagaagcuccggccccgcuggcuggacgcccggaccuacuccgacccccuggcccuccgcgaguucaaggaguucgcggccggccggcgcagcguguccggggaccugauccuggagaucggcaagcucccccagcaccugacccagcgggcccagaacgcccuggacaaccucgucaugcugcacaacagcgagcagggcgggcgcgcguaccggcacgccauggaggagcugccggacaccaucgagacgcucaugcugcuggcccucaucgccgugcugaccggcggggugacccuguucuuccucuccggccgcgggcugggcaagaccagcaucggccugcucugcgucauggccuccagcgugcugcuguggauggcguccguggagccccacuggaucgccgccagcaucauccucgaguucuuccugaugguccugcucauccccgagcccgaccggcagcgcaccccgcaggacaaccagcuggccuacguggugaucgggcugcucuucaugauccugacggucgccgcgaacgagaugggccugcucgagaccaccaagaaggaccuggggaucggccacguggccguggggaaccaccaccacgccgccaugcuggacgucgaccuccaccccgccuccgcguggacccuguacgccguggccacgaccaucaucacccccaugaugcggcacaccaucgagaacacgaccgccaacaucagccugaccgccaucgcgaaccaggccgccauccucaugggccuggacaagggcuggccgaucuccaagauggacaucggggugccccugcucgcccugggcugcuacagccaggucaacccccugacccucacggcggccgugcugaugcugguggcccacuacgccaucaucgggcccggccuccaggccaaggcgacccgcgaggcccagaagcgcaccgccgccgggaucaugaagaacccgaccgucgacggcaucguggccaucgaccuggaccccguggucuacgacgcgaaguucgagaagcagcugggccagaucaugcuccugauccugugcacgucccagauccuccugaugcggaccaccugggcccugugcgagagcaucacccucgccacggggccccugaccacccugugggagggcucccccgggaaguucuggaacaccacgaucgccgugagcauggccaacaucuuccgcggcuccuaccucgcgggcgccgggcuggccuucagccugaugaagagccucggcgggggccggcgcgggaccggcgcccagggcgagacccugggggagaaguggaagcggcagcugaaccagcucuccaagagcgaguucaacaccuacaagcgcuccggcaucauggagguggaccggagcgaggcgaaggaggggcugaagcgcggcgagacgaccaagcacgccgucucccgggggaccgccaagcugcgcugguucguggagcggaaccuggugaagccggagggcaaggucaucgaccucggcugcgggcgcggcggguggagcuacuacugcgccggccugaagaaggugaccgaggugaagggguacacgaagggcggccccgggcacgaggagcccauccccauggccaccuacggcuggaaccuggucaagcuccacuccgggaaggacguguucuucaucccgcccgagaagugcgacacccugcugugcgacaucggcgagagcucccccaaccccaccaucgaggaggggcggacgcuccgcgugcugaagauggucgagccguggcugcggggcaaccaguucugcaucaagauccucaaccccuacaugcccagcgugguggagacccuggagcagaugcagcgcaagcacggcgggaugcugguccggaacccccucucccgcaacagcacccacgagauguacuggguguccugcggcaccgggaacaucgugagcgcggucaacaugaccucccggaugcugcugaaccgcuucacgauggcccaccgcaagccgaccuacgagcgggacguggaccucggcgccggcacccgccacguggccgucgagcccgagguggccaaccuggacaucaucgggcagcggaucgagaacaucaagcacgagcacaagagcaccuggcacuacgacgaggacaaccccuacaagacgugggcguaccacggcuccuacgaggugaagcccagcggguccgccagcagcauggucaacggcguggucaagcugcucaccaagccgugggacgugauccccauggugacccagaucgccaugaccgacacgacccccuucgggcagcagcgcgucuucaaggagaagguggacacccggacccccaaggccaagcgcggcacggcccagaucauggaggugaccgcgaaguggcuguggggcuuccugucccggaacaagaagccgcgcaucugcacccgggaggaguucacccgcaagguccggagcaacgccgccaucggggccguguucguggacgagaaccaguggaacuccgcgaaggaggccgucgaggacggccgcuucugggaccucgugcaccgggagcgcgagcugcacaagcaggggaagugcgccacgugcguguacaacaugaugggcaagcgggagaagaagcugggggaguucggcaaggccaagggcagccgcgccaucugguacauguggcucggggcgcgguuccuggaguucgaggcccugggcuucaugaacgaggaccacugguucucccgcgagaacagccucuccggggucgagggcgaggggcugcacaagcugggcuacauccuccgggacaucagcaagauccccggcgggaacauguacgccgacgacaccgccggcugggacacccgcaucaccgaggacgaccugcagaacgaggcccggaucacggacaucauggagcccgagcacgcgcugcucgccaaguccaucuucaagcugaccuaccagaacaagguggugcgcguccagcgcccggccaagaacgggaccgugauggacgugaucagccggcgcgaccagcggggcuccggccaggucgggaccuacggccugaacacguucaccaacauggaggcccagcucauccgccagauggagagcgaggggaucuucucccccagcgagcuggagacccccaaccuggccgagcgggugcucgacuggcuggagaaguacggcguggagcgccugaagcggauggcgaucuccggggacgacugcgucgugaagcccaucgacgaccgcuucgccaccgcccucacggcccugaacgacaugggcaaggugcggaaggacaucccgcagugggagcccagcaagggcuggaacgacuggcagcagguccccuucugcucccaccacuuccaccagcugaucaugaaggacgggcgcgagaucguggugcccugccggaaccaggacgagcucgucggccgcgcccgggugagccagggggcgggcuggagccugcgcgagaccgccugccuggggaaguccuacgcccagauguggcagcucauguacuuccaccggcgcgaccugcggcuggccgcgaacgccaucugcagcgccgugccggucgacuggauccccaccucccgcaccacguggagcauccacgcccaccaccaguggaugaccaccgaggacaugcucuccguguggaaccggguguggaucgaggagaaccccuggauggaggacaagacccacaucagcuccuggggcgacguccccuaccugggcaagcgcgaggaccaguggugcgggagccugaucggccucacggcccgcgcgaccugggccaccaacauccagguggccaucaaccaggugcggcgccugaucgggaacgagaacuaccuggacuacaugaccuccaugaagcgguucaagaacgagagcgacccggagggcgcccucugguga

SEQ ID NO: 8051 - RNA, 9879 nt, Artificial Sequence
  derived and/or modified CDS sequence (opt1) from DENV-1__HM181954__SS-prME
agcgugaccaugcugcucaugcugaugcccaccgcccuggccuuccaccucaccacccggggcggggagccgcacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggacccccggggccagcaccagccaggagacguggaaccggcaggaccugcuggugaccuucaagaccgcccacgcgaagaagcaggagguggucgugcucggcucccaggagggcgccaugcacaccgcccugacgggggccaccgagauccagaccagcggcaccacgaccaucuucgccgggcaccugaagugccgccucaagauggacaagcugacccugaagggcauguccuacgugaugugcaccgggagcuucaagcucgagaaggaggucgcggagacgcagcacggcaccgugcuggugcagaucaaguacgagggcaccgacgcccccugcaagaucccguucuccacccaggacgagaagggggucacgcagaacggccggcugaucaccgccaaccccaucgugaccgacaaggagaagcccgugaacaucgaggccgagcccccguucggggagagcuacaucgucaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccguggggaagcugguccaccagaucuucggcgccgccuacgggguccucuucagcggcguguccuggaccaugaagaucgggaucggcguccugcugaccuggcucggccugaacagccgcuccacgagccuguccaugaccugcaucgccguggggcucgugacccuguaccugggcgucauggugcaggcggacagcgggugcgugaucaacuggaagggccgggagcucaagugcggguccggcaucuucgucaccaacgaggugcacacguggaccgagcaguacaaguuccaggccgacagccccaagcgccugagcgccgccaucggcaaggccugggaggagggggugugcggcauccgguccgcgacccgccuggagaacaucauguggaagcagaucagcaacgagcucaaccacauccugcuggagaacgacaugaaguucaccgucguggugggggacgucgccggcauccucgcccaggggaagaagaugauccggccccagcccauggaguacaaguacuccuggaaguccuggggcaaggccaagaucaucggcgcggacgugcagaacaccacguucaucaucgacgggccgaacacccccgagugccccgacgaccagcgcgccuggaacaucugggagguggaggacuacggcuucgggaucuucaccaccaacaucuggcugaagcugcgggacuccuacacgcaggccugcgaccaccgccucaugagcgccgccaucaaggacuccaaggcgguccacgccgacaugggcuacuggaucgagagcgagaagaacgagaccuggaagcuggcccgggccuccuucaucgaggugaagaccugcaucuggcccaagagccacacccugugguccaacggcgugcucgagagcgagaugaucaucccgaagaucuacgggggccccaucucccagcacaacuaccgccccggguacuucacgcagaccgccggcccguggcaccuggggaagcuggagcucgacuucgaccugugcgagggcaccaccgucgugguggacgagcacugcggcaaccgggggcccagccugcgcacgaccaccgucaccggcaagaucauccacgaguggugcugccgguccugcacgcugccgccccuccgcuuccgcggggaggacggcugcugguacgggauggagauccgcccggugaaggagaaggaggagaaccuggucaagagcauggucuccgcgggcagcggcgagguggacagcuucucccucgggcugcugugcaucagcaucaugaucgaggaggugaugcggucccgcuggagccggaagaugcucaugaccggcacccuggccgucuuccugcuccugaucauggggcagcugaccuggaacgaccucauccgccugugcaucauggugggcgccaacgccuccgaccgcauggggaugggcacgaccuaccuggcccucauggcgaccuucaagaugcggcccauguucgccguggggcugcuguuccgccggcucaccagccgcgagguccugcugcucacgaucgggcugucccugguggccagcguggagcuccccaacucccuggaggagcugggcgacgggcucgccaugggcaucaugauccugaagcugcucaccgacuuccagagccaccagcugugggcgacccugcucucccugaccuucaucaagacgaccuucagccugcacuacgccuggaagaccauggccaugguccucuccaucgugagccuguucccccugugccucuccaccacgagccagaagaccaccuggcugccgguccugcucggcucccuggggugcaagccccugaccauguuccucaucgccgagaacaagaucuggggccggcgcagcuggccccugaacgaggggaucauggccgugggcaucguguccauccugcucagcagccugcugaagaacgacgucccccucgcggggccgcugaucgccggcggcaugcugaucgccugcuacgugaucuccgggagcuccgccgaccucagccuggagaaggccgcggagguguccugggaggaggaggccgagcacagcggcgccucccacaacauccuggucgaggugcaggacgacgggacgaugaagaucaaggacgaggagcgggacgacacccucaccauccugcugaaggccacccuccuggccgugagcggcgucuacccccuguccauccccgcgacccucuucgugugguacuucuggcagaagaagaagcagcgcagcggggugcugugggacacgcccuccccgcccgaggucgagcgggccgugcuggacgacggcaucuaccgcaucaugcagcggggccugcucgggcgcagccaggugggcgucgggguguuccaggagaacguguuccacaccauguggcacgucacccggggcgccgugcugauguaccaggggaagcgccuggagcccuccugggccagcgugaagaaggaccucaucuccuacggcggcggguggcggcugcagggcagcuggaacaccggggaggagguccaggugaucgccguggagcccggcaagaacccgaagaacguccagacggcgcccgggaccuucaagacccccgagggcgaggugggcgccaucgcccuggacuucaagcccgggaccuccggcagcccgaucgugaaccgcgaggggaagaucgucggccucuacggcaacgggguggugacgaccuccggcaccuacgucagcgccaucgcgcaggccaaggccagccaggaggggccccugcccgagaucgaggacgagguguuccggaagcgcaaccugaccaucauggaccuccacccgggcuccgggaagacgcggcgcuaccugcccgccaucgugcgggaggccaucaagcgcaagcugcgcacccucauccuggcgcccacccgggucguggccagcgagauggccgaggcccugaagggcaugcccauccgcuaccagaccacggccgugaaguccgagcacaccggcaaggagaucgucgaccucaugugccacgcgaccuucaccaugcggcugcugagcccggugcgcgugcccaacuacaacaugaucaucauggacgaggcccacuucacggaccccuccagcaucgccgcccggggguacaucuccacccgcgucggcaugggggaggccgcggccaucuucaugaccgccacgccgcccggcagcguggaggccuucccccaguccaacgcggugauccaggacgaggagcgggacauccccgagcgcagcuggaacuccggguacgaguggaucacggacuuccccggcaagaccgucugguucgugcccagcaucaaguccggcaacgacaucgccaacugccuccggaagaacgggaagcgcgugauccagcugagccggaagaccuucgacaccgaguaccagaagacgaagaacaacgacugggacuacgucgugaccaccgacaucuccgagaugggcgccaacuuccgcgccgaccgggugaucgacccccgccggugccugaagcccgucauccucaaggacgggcccgagcgcgugauccuggccggcccgaugcccgugaccgucgcgagcgccgcccagcggcgcgggcggaucggccgcaaccacaacaaggagggcgaccaguacaucuacauggggcagccccugaacaacgacgaggaccacgcccacuggacggaggccaagaugcuccuggacaacaucaacacccccgagggcaucaucccggcgcuguucgagcccgagcgcgagaaguccgccgccaucgacggggaguaccggcuccgcggcgaggcccggaagaccuucguggagcugaugcgccgcggggaccugcccgucuggcucagcuacaagguggccuccgagggcuuccaguacagcgaccgccgguggugcuucgacggcgagcgcaacaaccaggugcuggaggagaacauggacgucgagaucuggaccaaggagggggagcggaagaagcugcgcccccgguggcucgacgcgcgcacguacagcgacccgcuggcccugcgggaguucaaggaguucgccgccggccgccgguccgugagcggggaccucauccuggagaucggcaagcugccccagcaccucacccagcgcgcgcagaacgcccuggacaaccuggugaugcuccacaacuccgagcagggcgggcgggccuaccgccacgccauggaggagcugcccgacaccaucgagacccugaugcuccuggcccugaucgcgguccucacgggcggggugacccuguucuuccugagcggccgggggcucggcaagaccuccaucggccugcugugcgugauggccagcuccguccuccuguggauggccagcguggagccccacuggaucgccgccuccaucauccuggaguucuuccucauggugcugcugaucccggagcccgaccgccagcggacgccccaggacaaccagcucgcguacgucgugaucgggcugcuguucaugauccucaccguggccgccaacgagaugggccugcuggagacgaccaagaaggaccucgggaucggccacgucgccguggggaaccaccaccacgccgcgaugcuggacguggaccugcacccggccagcgccuggacccucuacgccgucgccaccacgaucaucacccccaugaugcgccacaccaucgagaacaccacggcgaacaucucccugaccgccaucgccaaccaggccgcgauccugaugggccucgacaagggcuggcccaucagcaagauggacaucggggugccccugcuggcccucggcugcuacucccaggugaacccgcugacccugaccgccgccguccucaugcugguggcccacuacgcgaucaucgggcccggccugcaggccaaggccacgcgcgaggcccagaagcggaccgccgcggggaucaugaagaaccccaccguggacggcaucgucgccaucgaccucgaccccgugguguacgacgccaaguucgagaagcagcugggccagaucaugcugcucauccugugcaccagccagauccugcucaugcgcacgaccugggcccugugcgaguccaucacccuggccaccgggccgcucacgacccugugggagggcagccccgggaaguucuggaacaccaccaucgcggucuccauggccaacaucuuccggggcagcuaccuggccggcgccgggcucgcguucucccugaugaagucccugggcgggggccgccgggggacgggcgcccagggcgagacccucggggagaaguggaagcgccagcugaaccagcugagcaaguccgaguucaacaccuacaagcggagcggcaucauggagguggaccgcuccgaggccaaggaggggcucaagcggggcgagaccacgaagcacgccgugagccgcgggaccgccaagcugcggugguucgucgagcgcaaccuggugaagcccgagggcaaggugaucgaccugggcugcgggcggggcgggugguccuacuacugcgcgggccucaagaaggucaccgaggugaagggguacaccaagggcggccccgggcacgaggagccgauccccauggccacguacggcuggaaccuggugaagcugcacagcgggaaggacgucuucuucaucccgcccgagaagugcgacacccuccugugcgacaucggcgaguccagcccgaaccccaccaucgaggaggggcgcacccugcgggugcucaagaugguggagcccuggcugcgcggcaaccaguucugcaucaagauccugaaccccuacaugccguccgucguggagacgcucgagcagaugcagcggaagcacggcgggaugcuggugcgcaacccccugagccggaacuccacccacgagauguacugggucagcugcggcaccgggaacaucguguccgccgugaacaugaccagccgcaugcuccugaaccgcuucaccauggcccaccggaagcccacguacgagcgcgacgucgaccugggcgccggcacccggcacguggcgguggagcccgaggucgccaaccucgacaucaucgggcagcgcaucgagaacaucaagcacgagcacaaguccaccuggcacuacgacgaggacaacccguacaagaccugggccuaccacggcagcuacgaggugaagcccuccgggagcgccuccagcauggugaacggcgucgugaagcugcugacgaagcccugggacgucauccccauggugacccagaucgccaugaccgacaccacgccguucgggcagcagcggguguucaaggagaaggucgacacccgcacccccaaggcgaagcggggcaccgcccagaucauggaggugacggccaaguggcucuggggcuuccugagccgcaacaagaagccccggaucugcacccgcgaggaguucacccggaaggugcgcuccaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacacggcggggugggacacccggaucaccgaggacgaccuccagaacgaggcccgcaucaccgacaucauggagcccgagcacgcccugcuggccaagagcaucuucaagcucacguaccagaacaaggucgugcgcgugcagcggcccgccaagaacggcaccgucauggacgugaucucccgccgggaccagcgcgggagcggccaggugggcaccuacgggcugaacaccuucacgaacauggaggcgcagcugauccggcagauggaguccgagggcaucuucagccccuccgagcucgagaccccgaaccuggccgagcgcguccuggacuggcucgagaaguacgggguggagcggcugaagcgcauggccaucagcggcgacgacugcguggucaagcccaucgacgaccgguucgccaccgcccugaccgcgcucaacgacauggggaaggugcgcaaggacaucccccagugggagcccuccaagggcuggaacgacuggcagcaggucccguucugcagccaccacuuccaccagcugaucaugaaggacggccgggagaucgucgugcccugccgcaaccaggacgagcugguggggcgggcccgcgucucccagggcgccggguggagccuccgggagacggccugccugggcaagagcuacgcgcagauguggcagcugauguacuuccaccgccgggaccuccgccuggccgccaacgccaucugcuccgccgugcccguggacuggauccccaccagccggaccaccugguccauccacgcgcaccaccaguggaugacgaccgaggacaugcugagcgucuggaaccgcguguggaucgaggagaacccguggauggaggacaagacccacaucuccagcuggggcgacgugcccuaccucggcaagcgcgaggaccaguggugcggcucccugaucgggcugaccgcccgggccacgugggccaccaacauccaggucgccaucaaccaggugcgccggcucaucggcaacgagaacuaccuggacuacaugaccagcaugaagcgcuucaagaacgaguccgaccccgagggggcgcugugguga

SEQ ID NO: 8052 - RNA, 9879 nt, Artificial Sequence
  derived and/or modified CDS sequence (opt1) from DENV-1__HM181955__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgggacaagcgguccguggcccucgcgccccacgugggccuggggcuggagacgcgcaccgagaccuggaugagcuccgagagcgccuggaagcagauccagcgggucgagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugcccgacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccccuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuucuccacccaggacgagaagggcgucacgcagaacgggcggcugaucaccgccaacccgaucgugaccgacaaggagaagcccgugaacaucgaggccgagccgcccuucggcgagagcuacaucgucaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgugggcaagcugguccaccagaucuucgggaccgccuacggcgugcuguucagcgggguguccuggaccaugaagaucggcaucgggguccugcugacguggcucggccugaacagccgcuccaccagccuguccaugaccugcaucgccgugggccucgugacccuguaccugggggucauggugcaggccgacagcggcugcgugaucaacuggaaggggcgggagcucaagugcggcagcgggaucuucgucacgaacgaggugcacaccuggaccgagcaguacaaguuccaggcggacuccccgaagcgccugagcgccgccaucggcaaggccugggaggagggcgugugcgggauccgguccgccacccgccuggagaacaucauguggaagcagaucagcaacgagcucaaccacauccugcuggagaacgacaugaaguucaccgucguggugggcgacgucgcggggauccucgcccagggcaagaagaugauccggccccagcccauggaguacaaguacuccuggaaguccugggggaaggccaagaucaucggcgccgacgugcagaacacgaccuucaucaucgacggccccaacaccccggagugccccgacgaccagcgcgcguggaacaucugggagguggaggacuacggguucggcaucuucaccacgaacaucuggcugaagcugcgggacuccuacacccaggucugcgaccaccgccucaugagcgccgccaucaaggacuccaaggccgugcacgccgacaugggguacuggaucgagagcgagaagaacgagaccuggaagcuggcgcgggccuccuucaucgaggugaagaccugcaucuggcccaagagccacacgcugugguccaacggcguccucgagagcgagaugaucauccccaagaucuacggcgggccgaucucccagcacaacuaccgccccggcuacuucacccagaccgccgggcccuggcaccugggcaagcuggagcucgacuucgaccugugcgaggggaccacggugguggucgacgagcacugcggcaaccggggcccgagccugcgcaccaccaccgugacggggaagaucauccacgaguggugcugccgguccugcacccugccgccccuccgcuuccggggcgaggacgggugcugguacggcauggagauccgccccgugaaggagaaggaggagaaccuggucaagagcauggugagcgccggguccggcgagguggacagcuucucccucggccugcugugcaucagcaucaugaucgaggaggucaugcggucccgcuggagccggaagaugcucaugaccgggacccuggugguguuccugcuccugaucaugggccagcugacguggaacgaccucauccgccugugcaucauggucggggccaacgcguccgaccgcaugggcauggggaccaccuaccuggcccucauggccaccuucaagaugcggccgauguucgccgugggccugcuguuccgccggcucacgagccgcgaggugcugcugcucaccaucggccugucccuggucgccagcguggagcuccccaacucccuggaggagcugggggacggccucgcgauggggaucaugauccugaagcugcucaccgacuuccagagccaccagcugugggccacccugcucucccugacguucaucaagaccaccuucagccugcacuacgccuggaagaccauggccaugguccucuccaucgugagccuguucccccugugccucuccacgaccagccagaagaccaccuggcugcccgugcugcucggcucccugggcugcaagccgcugacgauguuccucaucgcggagaacaagaucugggggcggcgcagcuggccccugaacgagggcaucauggccgucgggaucgugagcauccugcucuccagccugcugaagaacgacgugccccucgccggcccccugaucgccgggggcaugcugaucgccugcuacgucaucuccggcagcuccgcggaccucagccuggagaaggccgccgagguguccugggaggaggaggccgagcacagcggggccucccacaacauccugguggagguccaggacgacggcaccaugaagaucaaggacgaggagcgggacgacacccucaccauccugcugaaggcgacccuccuggccgugagcgggguguacccgcuguccauccccgccacccucuucgucugguacuucuggcagaagaagaagcagcgcagcggcgugcugugggacacccccagcccgcccgagguggagcgggccguccuggacgacgggaucuaccgcaucaugcagcggggccugcucggccgcagccaggugggggugggcgucuuccaggagaacguguuccacaccauguggcacgugacccgcggggcgguccugauguaccagggcaagcgccuggagcccuccugggcgagcgugaagaaggaccucaucuccuacgggggcggcuggcggcugcaggggagcuggaacacgggcgaggaggugcaggucaucgccguggagcccgggaagaaccccaagaacgugcagaccgcccccggcaccuucaagacccccgagggggaggucggcgccaucgcccuggacuucaagcccggcacguccgggagccccaucgugaaccgcgagggcaagaucguggggcucuacggcaacggcgucgugaccaccagcgggaccuacguguccgcgaucgcccaggccaaggccagccaggagggcccgcugcccgagaucgaggacgaggucuuccggaagcgcaaccugacgaucauggaccuccaccccggguccggcaagacccggcgcuaccugccggcgaucgugcgggaggccaucaagcgcaagcugcgcacccucauccuggcccccacccggguggucgccagcgagauggccgaggcgcugaaggggaugcccauccgcuaccagacgaccgccgugaaguccgagcacaccggcaaggagaucguggaccucaugugccacgccaccuucacgaugcggcugcugagccccguccgcgugccgaacuacaacaugaucaucauggacgaggcccacuucaccgaccccuccagcaucgccgcgcggggcuacaucuccacccgcguggggaugggcgaggccgccgccaucuucaugaccgccacgccgcccgggagcgucgaggcguucccgcaguccaacgccgugauccaggacgaggagcgggacauccccgagcgcagcuggaacuccggcuacgaguggaucaccgacuuccccgggaagaccgugugguucguccccagcaucaaguccggcaacgacaucgccaacugccuccggaagaacggcaagcgcgugauccagcugagccggaagaccuucgacacggaguaccagaagaccaagaacaacgacugggacuacguggucaccaccgacaucuccgagaugggggccaacuuccgcgcggaccgggugaucgacccgcgccggugccugaagcccgugauccucaaggacggccccgagcgcgucauccuggccgggcccaugccggugacggucgccagcgccgcccagcggcgcggccggaucgggcgcaaccacaacaaggagggcgaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccaucgacggcgaguaccggcuccgcggggaggcgcggaagaccuucguggagcugaugcgccggggcgaccugcccguguggcucagcuacaaggucgccagcgagggguuccaguacuccgaccgccgguggugcuucgacggcgagcgcaacaaccaggugcuggaggagaacauggacguggagaucuggacgaaggagggcgagcggaagaagcugcgcccccgguggcucgacgcccgcaccuacagcgacccccuggcccugcgggaguucaaggaguucgccgcggggcgccgguccgucagcggcgaccucauccuggagaucgggaagcugccgcagcaccucacccagcgcgcccagaacgcccuggacaaccuggugaugcuccacaacuccgagcagggcggccgggccuaccgccacgcgauggaggagcugcccgacaccaucgagacgcugaugcuccuggcccugaucgccgugcucaccgggggcgucacccuguucuuccugagcgggcggggccucgggaagaccuccaucggccugcugugcgugauggccagcuccgugcuccuguggauggccagcgucgagccccacuggaucgcggccuccaucauccuggaguucuuccucauggugcugcugauccccgagccggaccgccagcggacgccccaggacaaccagcucgccuacguggucaucggccugcuguucaugauccucacgguggccgccaacgagauggggcugcuggagaccaccaagaaggaccucggcaucgggcacguggcggucggcaaccaccaccacgccgccaugcuggacguggaccugcaccccgccagcgccuggacccucuacgcgguggccacgaccaucaucaccccgaugaugcgccacaccaucgagaacacgaccgccaacaucucccugaccgccaucgccaaccaggcggccauccugauggggcucgacaagggcuggcccaucagcaagauggacaucggcgucccccugcuggcccucgggugcuacucccaggugaacccccugacccugacggccgcggugcucaugcuggucgcccacuacgccaucaucggcccggggcugcaggccaaggccacccgcgaggcgcagaagcggaccgccgccggcaucaugaagaaccccaccguggacgggaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacgggcccccucaccacccugugggaggggagcccgggcaaguucuggaacaccacgaucgccguguccauggccaacaucuuccgggggagcuaccuggccggcgcgggccucgccuucagccugaugaagucccucgggggcgggcgccgggggaccggggcccagggcgagacccucggcgagaaguggaagcgccagcugaaccagcugagcaaguccgaguucaacaccuacaagcggagcgggaucauggaggucgaccgcuccgaggccaaggagggccucaagcgcggggagacgaccaagcacgcggugagccgcggcaccgccaagcugcggugguucguggagcgcaaccuggucaagcccgaggggaaggugaucgaccugggcugcggccgcggcgggugguccuacuacugcgccgggcucaagaaggugaccgaggucaagggguacacgaagggcgggcccggccacgaggagcccaucccgauggccaccuacggguggaaccuggugaagcugcacagcggcaaggacguguucuucaucccgcccgagaagugcgacacccuccugugcgacaucggggaguccagccccaacccgaccaucgaggagggccgcacgcugcggguccucaagaugguggagcccuggcugcgcgggaaccaguucugcaucaagauccugaaccccuacaugcccuccguggucgagacccucgagcagaugcagcggaagcacggcggcaugcuggugcgcaacccgcugagccggaacuccacccacgagauguacugggugagcugcgggaccggcaacaucgucuccgccgugaacaugaccagccgcaugcuccugaaccgcuucacgauggcgcaccggaagcccaccuacgagcgcgacguggaccugggggccggcacccggcacgucgccguggagcccgagguggccaaccucgacaucaucggccagcgcaucgagaacaucaagcacgagcacaaguccaccuggcacuacgacgaggacaaccccuacaagacgugggccuaccacgggagcuacgaggucaagccguccggcagcgcgagcuccauggugaacggggucgugaagcugcugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgccaaguggcucuggggcuuccugagccgcaacaagaagccccggaucugcacccgcgaggaguucacccggaaggugcgcuccaacgcggccaucggcgccguguucgucgacgagaaccaguggaacagcgccaaggaggcgguggaggacgagcgguucugggaccuggugcaccgcgagcgggagcuccacaagcaggggaagugcgccacgugcgucuacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucaccgaggacgaccuccagaacgaggcccgcaucacggacaucauggagccggagcacgcccugcuggccaagagcaucuucaagcucaccuaccagaacaaggugguccgcgugcagcggcccgccaagaacgggaccgugauggacgucaucucccgccgggaccagcgcggcagcggccaggugggcaccuacggccugaacacguucaccaacauggaggcccagcugauccggcagauggaguccgaggggaucuucagccccuccgagcucgagacccccaaccuggccgagcgcgugcuggacuggcucgagaaguacggcgucgagcggcugaagcgcauggccaucagcggggacgacugcguggugaagccgaucgacgaccgguucgcgaccgcccugacggcccucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcccgcgugagccagggggccggcuggucccuccgggagaccgcgugccugggcaagagcuacgcccagauguggcagcugauguacuuccaccgccgggaccuccgccuggccgccaacgcgaucugcuccgccguccccguggacuggauccccaccagccggaccacgugguccauccacgcccaccaccaguggaugaccaccgaggacaugcugagcguguggaaccgcgucuggaucgaggagaaccccuggauggaggacaagacccacaucuccagcuggggcgacgugccguaccucgggaagcgcgaggaccaguggugcggcucccugaucggccugacggcccgggccaccugggcgaccaacauccagguggccaucaaccagguccgccggcucaucgggaacgagaacuaccuggacuacaugaccagcaugaagcgcuucaagaacgaguccgaccccgagggcgcccugugguga

SEQ ID NO: 8053 - RNA, 9879 nt, Artificial Sequence
  derived and/or modified CDS sequence (opt1) from DENV-1__HM181959__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggugaccuacgggaccugcagccagaccggcgagcaccggcgggacaagcgguccguggcccucgcgccccacgugggccuggggcuggagacgcgcaccgagaccuggaugagcuccgagagcgccuggaagcagauccagcgggucgagaccugggcccuccgccaccccggcuucacggugaucgcccuguuccuggcgcacgccaucgggaccuccaucacccagaagggcaucaucuucauccuccugaugcuggugacccccagcauggccaugcggugcgucgggaucggcucccgcgacuucguggagggccucagcggggccacguggguggacgucgugcuggagcacggcuccugcgugaccaccauggccaaggacaagcccacccuggacaucgagcuccugaagacggaggucaccaaccccgcgauccugcggaagcucugcaucgaggccaagaucagcaacaccaccacggacucccgcugcccgacccagggggaggccacccugguggaggagcaggacgccaacuucgugugccggcgcaccuucgucgaccggggcuggggcaacgggugcggccuguucgggaagggcagccucaucacgugcgccaaguucaagugcgugaccaagcuggaggggaagaucgugcaguacgagaaccugaaguacuccgucaucgugaccgugcacaccggcgaccagcaccaggucggcaacgagagcacggagcacgggaccaccgcgaccaucacgccccaggcccccacgaccgagauccagcucaccgacuacggcgcccugacccuggacugcagcccccggacggggcucgacuucaacgagauggugcugcugaccaugaaggagaaguccuggcucguccacaagcagugguuccuggaccugccccuccccuggaccagcggcgccuccaccagccaggagacguggaaccggcaggaccugcuggugaccuucaagaccgcccacgcgaagaagcaggagguggucgugcucgggucccaggagggcgccaugcacaccgcccugacgggcgccaccgagauccagaccagcgggaccacgaccaucuucgccggccaccugaagugccgccucaagauggacaagcugacccugaaggggauguccuacgugaugugcaccggcagcuucaagcucgagaaggaggucgcggagacgcagcacgggaccgugcuggugcagaucaaguacgagggcaccgacgcccccugcaagauccccuucuccacccaggacgagaagggcgucacgcagaacgggcggcugaucaccgccaacccgaucgugaccgacaaggagaagcccgugaacaucgaggccgagccgcccuucggcgagagcuacaucgucaucggggcgggcgagaaggcccugaagcucuccugguucaagaagggcagcuccaucgggaagauguucgaggccaccgcccgcggcgcccggcgcauggcgauccugggggacacggccugggacuucggcagcaucgggggcguguucaccuccgugggcaagcugguccaccagaucuucgggaccgccuacggcgugcuguucagcgggguguccuggaccaugaagaucggcaucgggguccugcugacguggcucggccugaacagccgcuccaccagccuguccaugaccugcaucgccgugggccucgugacccuguaccugggggucauggugcaggccgacagcggcugcgugaucaacuggaaggggcgggagcucaagugcggcagcgggaucuucgucacgaacgaggugcacaccuggaccgagcaguacaaguuccaggcggacuccccgaagcgccugagcgccgccaucggcaaggccugggaggagggcgugugcgggauccgguccgccacccgccuggagaacaucauguggaagcagaucagcaacgagcucaaccacauccugcuggagaacgacaugaaguucaccgucguggugggcgacgucgcggggauccucgcccagggcaagaagaugauccggccccagcccauggaguacaaguacuccuggaaguccugggggaaggccaaggugaucggcgccgacgugcagaacacgaccuucaucaucgacggccccaacaccccggagugccccgacgaccagcgcgcguggaacaucugggaggucgaggacuacggguucggcaucuucaccacgaacaucuggcugaagcugcgggacuccuacacccaggugugcgaccaccgccucaugagcgccgccaucaaggacuccaaggccgugcacgccgacaugggguacuggaucgagagcgagaagaacgagaccuggaagcuggcgcgggccuccuucaucgaggucaagaccugcaucuggcccaagagccacacgcugugguccaacggcgugcucgagagcgagaugaucauccccaagaucuacggcgggccgaucucccagcacaacuaccgccccggcuacuucacccagaccgccgggcccuggcaccugggcaagcuggagcucgacuucgaccugugcgaggggaccacgguggucguggacgagcacugcggcaaccggggcccgagccugcgcaccaccaccgugacggggaagaucauccacgaguggugcugccgguccugcacccugccgccccuccgcuuccggggcgaggacgggugcugguacggcauggagauccgccccgucaaggagaaggaggagaaccuggucaagagcauggugagcgccggguccggcgaggucgacagcuucucccucggccugcugugcaucagcaucaugaucgaggaggugaugcggucccgcuggagccggaagaugcucaugaccgggacccugguggucuuccugcuccugaucaugggccagcugacguggaacgaccucauccgccugugcaucauggugggggccaacgcguccgaccgcaugggcauggggaccaccuaccuggcccucauggccaccuucaagaugcggccgauguucgccgugggccugcuguuccgccggcucacgagccgcgagguccugcugcucaccaucggccugucccugguggccagcgucgagcuccccaacucccuggaggagcugggggacggccucgcgauggggaucaugauccugaagcugcucaccgacuuccagagccaccagcugugggccacccugcucucccugacguucaucaagaccaccuucagccugcacuacgccuggaagaccauggccauggugcucuccaucgugagccuguucccccugugccucuccacgaccagccagaagaccaccuggcugcccguccugcucggcucccugggcugcaagccgcugacgauguuccucaucgcggagaacaagaucugggggcggcgcagcuggccccugaacgagggcaucauggccguggggaucgugagcauccugcucuccagccugcugaagaacgacgucccccucgccggcccccugaucgccgggggcaugcugaucgccugcuacgugaucuccggcagcuccgcggaccucagccuggagaaggccgccgagguguccugggaggaggaggccgagcacagcggggccucccacaacauccuggucgaggugcaggacgacggcaccaugaagaucaaggacgaggagcgggacgacacccucaccauccugcugaaggcgacccuccuggccgugagcggggucuacccgcuguccauccccgccacccucuucgugugguacuucuggcagaagaagaagcagcgcagcggcgugcugugggacacccccagcccgcccgaggucgagcgggccgugcuggacgacgggaucuaccgcaucaugcagcggggccugcucggccgcagccaggugggggucggcguguuccaggagaacguguuccacaccauguggcacgucacccgcggggcggugcugauguaccagggcaagcgccuggagcccuccugggcgagcgugaagaaggaccucaucuccuacgggggcggcuggcggcugcaggggagcuggaacacgggcgaggagguccaggugaucgccguggagcccgggaagaaccccaagaacguccagaccgcccccggcaccuucaagacccccgagggggaggugggcgccaucgcccuggacuucaagcccggcacguccgggagccccaucgugaaccgcgagggcaagaucgucgggcucuacggcaacggcguggugaccaccagcgggaccuacgucuccgcgaucgcccaggccaaggccagccaggagggcccgcugcccgagaucgaggacgagguguuccggaagcgcaaccugacgaucauggaccuccaccccggguccggcaagacccggcgcuaccugccggcgaucgugcgggaggccaucaagcgcaagcugcgcacccucauccuggcccccacccgggucguggccagcgagauggccgaggcgcugaaggggaugcccauccgcuaccagacgaccgccgugaaguccgagcacaccggcaaggagaucgucgaccucaugugccacgccaccuucacgaugcggcugcugagccccgugcgcgugccgaacuacaacaugaucaucauggacgaggcccacuucaccgaccccuccagcaucgccgcgcggggcuacaucuccacccgcgucgggaugggcgaggccgccgccaucuucaugaccgccacgccgcccgggagcguggaggcguucccgcaguccaacgccgugauccaggacgaggagcgggacauccccgagcgcagcuggaacuccggcuacgaguggaucaccgacuuccccgggaagaccgucugguucgugcccagcaucaaguccggcaacgacaucgccaacugccuccggaagaacggcaagcgcgugauccagcugagccggaagaccuucgacacggaguaccagaagaccaagaacaacgacugggacuacgucgugaccaccgacaucuccgagaugggggccaacuuccgcgcggaccgggugaucgacccgcgccggugccugaagcccgucauccucaaggacggccccgagcgcgugauccuggccgggcccaugccggucacgguggccagcgccgcccagcggcgcggccggaucgggcgcaaccacaacaaggagggcgaccaguacaucuacaugggccagccccugaacaacgacgaggaccacgcgcacuggaccgaggccaagaugcuccuggacaacaucaacacccccgaggggaucauccccgcccuguucgagccggagcgcgagaaguccgccgccaucgacggcgaguaccggcuccgcggggaggcgcggaagaccuucguggagcugaugcgccggggcgaccugcccgucuggcucagcuacaagguggccagcgagggguuccaguacuccgaccgccgguggugcuucgacggcgagcgcaacaaccaggugcuggaggagaacauggacgucgagaucuggacgaaggagggcgagcggaagaagcugcgcccccgguggcucgacgcccgcaccuacagcgacccccuggcccugcgggaguucaaggaguucgccgcggggcgccgguccgugagcggcgaccucauccuggagaucgggaagcugccgcagcaccucacccagcgcgcccagaacgcccuggacaaccuggugaugcuccacaacuccgagcagggcggccgggccuaccgccacgcgauggaggagcugcccgacaccaucgagacgcugaugcuccuggcccugaucgccguccucaccgggggcgugacccuguucuuccugagcgggcggggccucgggaagaccuccaucggccugcugugcgugauggccagcuccguccuccuguggauggccagcguggagccccacuggaucgcggccuccaucauccuggaguucuuccucauggugcugcugauccccgagccggaccgccagcggacgccccaggacaaccagcucgccuacgucgugaucggccugcuguucaugauccucacgguggccgccaacgagauggggcugcuggagaccaccaagaaggaccucggcaucgggcacgucgcggugggcaaccaccaccacgccgccaugcuggacguggaccugcaccccgccagcgccuggacccucuacgcggucgccacgaccaucaucaccccgaugaugcgccacaccaucgagaacacgaccgccaacaucucccugaccgccaucgccaaccaggcggccauccugauggggcucgacaagggcuggcccaucagcaagauggacaucggcgugccccugcuggcccucgggugcuacucccaggugaacccccugacccugacggccgcgguccucaugcugguggcccacuacgccaucaucggcccggggcugcaggccaaggccacccgcgaggcgcagaagcggaccgccgccggcaucaugaagaaccccaccguggacgggaucgucgccaucgaccucgaccccgugguguacgacgccaaguucgagaagcagcugggccagaucaugcugcucauccugugcacgagccagauccugcucaugcgcaccaccugggcgcugugcgaguccaucacccuggccacgggcccccucaccacccugugggaggggagcccgggcaaguucuggaacaccacgaucgccgucuccauggccaacaucuuccgggggagcuaccuggccggcgcgggccucgccuucagccugaugaagucccucgggggcgggcgccgggggaccggggcccagggcgagacccucggcgagaaguggaagcgccagcugaaccagcugagcaaguccgaguucaacaccuacaagcggagcgggaucauggagguggaccgcuccgaggccaaggagggccucaagcgcggggagacgaccaagcacgcggugagccgcggcaccgccaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcgggcccggccacgaggagcccaucccgauggccaccuacggguggaaccuggugaagcugcacagcggcaaggacgucuucuucaucccgcccgagaagugcgacacccuccugugcgacaucggggaguccagccccaacccgaccaucgaggagggccgcacgcugcgggugcucaagaugguggagcccuggcugcgcgggaaccaguucugcaucaagauccugaaccccuacaugcccuccgucguggagacccucgagcagaugcagcggaagcacggcggcaugcuggugcgcaacccgcugagccggaacuccacccacgagauguacugggucagcugcgggaccggcaacaucguguccgccgugaacaugaccagccgcaugcuccugaaccgcuucacgauggcgcaccggaagcccaccuacgagcgcgacgucgaccugggggccggcacccggcacguggccguggagcccgaggucgccaaccucgacaucaucggccagcgcaucgagaacaucaagcacgagcacaaguccaccuggcacuacgacgaggacaaccccuacaagacgugggccuaccacgggagcuacgaggugaagccguccggcagcgcgagcuccauggucaacgggguggugaagcugcugaccaagcccugggacgucauccccauggugacccagaucgccaugaccgacacgacccccuucggccagcagcggguguucaaggagaaggucgacacccgcaccccgaaggccaagcgggggacggcccagaucauggaggugaccgccaaguggcucuggggcuuccugagccgcaacaagaagccccggaucugcacccgcgaggaguucacccggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgccacgugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacccggaucaccgaggacgaccuccagaacgaggcccgcaucacggacaucauggagccggagcacgcccugcuggccaagagcaucuucaagcucaccuaccagaacaaggucgugcgcgugcagcggcccgccaagaacgggaccgucauggacgugaucucccgccgggaccagcgcggcagcggccaggugggcaccuacggccugaacacguucaccaacauggaggcccagcugauccggcagauggaguccgaggggaucuucagccccuccgagcucgagacccccaaccuggccgagcgcguccuggacuggcucgagaaguacggcguggagcggcugaagcgcauggccaucagcggggacgacugcguggucaagccgaucgacgaccgguucgcgaccgcccugacggcccucaacgacaugggcaaggugcgcaaggacaucccccagugggagcccuccaagggguggaacgacuggcagcagguccccuucugcagccaccacuuccaccagcugaucaugaaggacggccgggagaucgucgugccgugccgcaaccaggacgagcuggugggccgggcccgcgucagccagggggccggcuggucccuccgggagaccgcgugccugggcaagagcuacgcccagauguggcagcugauguacuuccaccgccgggaccuccgccuggccgccaacgcgaucugcuccgccgugcccguggacuggauccccaccagccggaccacgugguccauccacgcccaccaccaguggaugaccaccgaggacaugcugagcgucuggaaccgcguguggaucgaggagaaccccuggauggaggacaagacccacaucuccagcuggggcgacgugccguaccucgggaagcgcgaggaccaguggugcggcucccugaucggccugacggcccgggccaccugggcgaccaacauccaggucgccaucaaccaggugcgccggcucaucgggaacgagaacuaccuggacuacaugaccagcaugaagcgcuucaagaacgaguccgaccccgagggcgcccugugguga

SEQ ID NO: 8054 - RNA, 9879 nt, Artificial Sequence
  derived and/or modified CDS sequence (opt1) from DENV-1__JF937651__SS-prME
agcgugaccaugcugcucaugcugaugcccaccgcccuggccuuccaccucaccacccggggcggggagccccacaugauccuguccaagcaggagcggggcaagagccuccuguucaagaccuccgcgggggugaacaugugcacccugaucgccauggaccugggggagcucugcgaggacaccaugaccuacaagugcccccggaucaccgaggccgagcccgacgacguggacugcuggugcaacgccaccgacacgugggugaccuacgggaccugcagccagaccggggagcaccggcgcgacaagcgguccgucgcccuggcgccccacgugggccuggggcucgagacgcgcaccgagaccuggaugagcuccgagggcgccuggaagcagauccagcggguggagaccugggcccugcgccaccccggguucacggucaucgcccuguuccucgcgcacgccaucggcaccagcaucacccagaaggggaucaucuucauccugcugaugcucgugacccccuccauggccaugcggugcgugggcaucggcagccgcgacuucgucgaggggcuguccggcgccacguggguggacgugguccuggagcacgggagcugcgugaccaccauggccaaggacaagcccacccucgacaucgagcugcugaagacggaggugaccaaccccgcgauccuccggaagcugugcaucgaggccaagaucuccaacaccaccacggacagccgcugcccgacccagggcgaggccacccuggucgaggagcaggacgccaacuucgugugccggcgcaccuucguggaccggggcugggggaacggcugcggccuguucggcaaggggucccugaucacgugcgccaaguucaagugcgucaccaagcuggagggcaagaucgugcaguacgagaaccucaaguacagcgugaucgucaccgugcacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgucuucaccagcguggggaagcucauccaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcuccgggacagcuacacccaggugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcucuggagcaacggcgugcuggaguccgagaugaucauccccaagaucuacgggggcccgaucagccagcacaacuaccgccccggguacuucacccagaccgccggccccuggcaccuggggaagcucgagcuggacuucgaccugugcgagggcaccacgguggucguggacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacccuggccguguuccuccugcugaucauggggcagcucacguggaacgaccugauccgccugugcaucauggucggcgcgaacgccugcgaccgcauggggaugggcaccaccuaccucgcccugauggccaccuucaagaugcggccgauguucgccgugggccuccuguuccgccggcugacgagccgcgaggugcugcuccugaccaucgggcugucccucgucgcgagcguggagcugcccaacucccuggaggagcucggcgacgggcuggccaugggcaucaugauccugaagcuccugaccgacuuccagagcuaccagcugugggccacccuccugucccugacguucaucaagaccaccuucagccuccacuacgccuggaagaccauggcgauggugcuguccaucgucagccuguucccccucugccuguccacgaccagccagaagaccaccuggcugcccgugcuccugggcucccuggggugcaagccgcucacgauguuccugaucgccgagaacaagaucuggggccggcgcagcuggccccugaacgaggggaucauggccgucggcaucguguccauccuccugagcagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggaccaugaagaucaaggacgaggagcgggacgacacccugaccauccugcucaaggccacccugcuggccgugagcggcguguacccgcucuccauccccgccacgcuguucgucugguacuucuggcagaagaagaagcagcgcagcggggugcugugggacacccccagcccgcccgagguggagcgggccguccuggacgacggcaucuaccgcaucaugcagcggggccuccuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacacgggggaggaggugcaggucaucgccguggagcccggcaagaaccccaagaacgugcagaccgcccccgggaccuucaagacccccgagggcgaggucggcgccaucgcgcucgacuucaagcccgggacguccggcagccccaucgugaaccgcgaggggaagaucgugggccuguacggcaacggggucgugaccaccuccggcaccuacgugagcgccaucgcccaggccaaggcgagccaggaggggccgcugcccgagaucgaggacgaggucuuccggaagcgcaaccucacgaucauggaccugcaccccggcuccgggaagacccggcgcuaccugccggccaucgugcgggaggccaucaagcgcaagcuccgcacccugauccuggcccccacccggguggucgccagcgagauggcggaggcccucaagggcaugcccauccgcuaccagacgaccgccgugaaguccgagcacaccggcaaggagaucguggaccugaugugccacgccaccuucacgaugcggcugcucagccccguccgcgugccgaacuacaacaugaucaucauggacgaggcccacuucaccgaccccuccagcaucgcggcccggggguacaucuccacccgcgugggcaugggggaggccgccgccaucuucaugaccgcgacgccgcccggcagcgucgaggccuucccgcaguccaacgccgugauccaggacgaggagcgggacauccccgagcgcagcuggaacuccggguacgaguggaucaccgacuuccccggcaagaccgugugguucguccccagcaucaaguccggcaacgacaucgccaacugccugcggaagaacgggaagcgcgugauccagcugagccggaagaccuucgacacggaguaccagaagaccaagaacaacgacugggacuacguggucaccaccgacaucuccgagaugggcgcgaacuuccgcgccgaccgggugaucgacccgcgccggugccucaagcccgugauccugaaggacgggcccgagcgcgucauccuggccggccccaugccggugacgguggccagcgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucgucgagcugaugcgccgcggggaccuccccguguggcugagcuacaaggucgccuccgagggcuuccaguacagcgaccgccgguggugcuucgacggcgagcgcaacaaccaggugcuggaggagaacauggacguggagaucuggacgaaggagggggagcggaagaagcuccgcccccgguggcuggacgcccgcaccuacagcgacccccuggcccuccgggaguucaaggaguucgcggccggccgccgguccgucagcggggaccugauccuggagaucggcaagcucccgcagcaccugacccagcgcgcccagaacgcccuggacaaccucgugaugcugcacaacuccgagcagggcgggcgggcguaccgccacgccauggaggagcugcccgacaccaucgagacgcucaugcugcuggcccucaucgccgugcugaccggcggggucacccuguucuuccucagcggccgggggcugggcaagaccuccaucggccugcucugcgugauggccagcuccgugcugcuguggauggcgagcgucgagccccacuggaucgccgccuccaucauccucgaguucuuccugauggugcugcucauccccgagccggaccgccagcggacgccccaggacaaccagcuggccuacguggucaucgggcuccucuucaugauccugacgguggccgcgaacgagaugggccugcucgagaccaccaagaaggaccuggggaucggccacguggccgucgggaaccaccaccacgccgccaugcuggacguggaccuccaccccgccagcgcguggacccuguacgccguggccacgaccaucaucaccccgaugaugaagcacaccaucgagaacacgaccgccaacaucucccugaccgccaucgcgaaccaggccgccauccucaugggccuggacaagggcuggcccaucagcaagauggacaucggggucccccugcucgcccugggcugcuacucccaggugaacccccugacccucacggcggccgugcugaugcuggucgcccacuacgccaucaucgggccgggccuccaggccaaggcgacccgcgaggcccagaagcgcaccgccgccgggaucaugaagaaccccaccguggacggcaucguggccaucgaccuggaccccgucguguacgacgcgaaguucgagaagcagcugggccagaucaugcuccugauccugugcacgagccagauccuccugaugcggaccaccugggcccugugcgaguccaucacccucgccacggggccccugaccacccugugggagggcagcccggggaaguucuggaacaccacgaucgccguguccauggccaacaucuuccgcggcagcuaccucgcgggcgccgggcuggccuucucccugaugaagucccucggcgggggccggcgcgggaccggcgcccagggcgagacccugggggagaaguggaagcggcagcugaaccagcucagcaaguccgaguucaacaccuacaagcgcagcggcaucauggaggucgaccgguccgaggcgaaggaggggcugaagcgcggcgagacgaccaagcacgccgugagccgggggaccgccaagcugcgcugguucguggagcggaaccuggucaagcccgagggcaaggugaucgaccucggcugcgggcgcggcgggugguccuacuacugcgccggccugaagaaggugaccgaggucaagggguacacgaagggcggccccgggcacgaggagcccaucccgauggccaccuacggcuggaaccuggugaagcuccacagcgggaaggacguguucuucaucccgcccgagaagugcgacacccugcugugcgacaucggcgaguccagccccaacccgaccaucgaggaggggcggacgcuccgcguccugaagaugguggagcccuggcugcggggcaaccaguucugcaucaagauccucaaccccuacaugcccuccguggucgagacccuggagcagaugcagcgcaagcacggcgggaugcuggugcggaacccgcucagccgcaacuccacccacgagauguacugggugagcugcggcaccgggaacaucgucuccgcggugaacaugaccagccggaugcugcugaaccgcuucacgauggcccaccgcaagcccaccuacgagcgggacguggaccucggcgccggcacccgccacgucgccguggagcccgagguggccaaccuggacaucaucgggcagcggaucgagaacaucaagcacgagcacaaguccaccuggcacuacgacgaggacaaccccuacaagacgugggcguaccacggcagcuacgaggucaagccguccgggagcgccuccagcauggugaacggcguggucaagcugcucaccaagcccugggacgugauccccauggucacccagaucgccaugaccgacacgacccccuucgggcagcagcgcguguucaaggagaagguggacacccggaccccgaaggccaagcgcggcacggcccagaucauggaggucaccgcgaaguggcuguggggcuuccugagccggaacaagaagccccgcaucugcacccgggaggaguucaccgggaaggugcgcuccaacgccgccaucggcgccguguucgucgacgagaaccaguggaacagcgcgaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggccaagggcucccgggccaucugguacauguggcucggggcgcgcuuccuggaguucgaggcccugggcuucaugaacgaggaccacugguucagccgggagaacucccucagcgggguggagggcgaggggcugcacaagcugggcuacauccuccgcgacaucuccaagauccccggcgggaacauguacgccgacgacaccgccggcugggacacccggaucaccgaggacgaccugcagaacgaggcccgcaucacggacaucauggagccggagcacgcgcugcucgccaagagcaucuucaagcugaccuaccagaacaaggugguccgggugcagcgccccgccaagaacgggaccgugauggacgucaucucccgccgggaccagcgcggcagcggccagguggggaccuacggccugaacacguucaccaacauggaggcccagcucauccggcagauggaguccgaggggaucuucagccccuccgagcuggagacccccaaccuggccgagcgcgugcucgacuggcuggagaaguacggcgucgagcggcugaagcgcauggcgaucagcggggacgacugcguggugaagccgaucgacgaccgguucgccaccgcccucacggcccugaacgacaugggcaagguccgcaaggacaucccccagugggagcccuccaagggcuggaacgacuggcagcagguccccuucugcagccaccacuuccaccagcugaucaugaaggacgggcgggagaucguggucccgugccgcaaccaggacgagcucgugggccgggcccgcgugucccagggggcgggcuggagccugcgggagaccgccugccugggcaagagcuacgcccagauguggcagcucauguacuuccaccgccgggaccugcgccuggccgcgaacgccaucugcuccgccguccccguggacuggauccccaccagccggaccacgugguccauccacgcccaccaccaguggaugaccaccgaggacaugcucagcguguggaaccgcgucuggaucgaggagaaccccuggauggaggacaagacccacaucuccagcuggggcgacgugccguaccugggcaagcgggaggaccaguggugcgggucccugaucggccucacggcccgcgcgaccugggccaccaacauccagguggccaucaaccagguccgccggcugaucgggaacgagaacuaccuggacuacaugaccagcaugaagcgcuucaagaacgaguccgaccccaagggcgcccucugguga

SEQ ID NO: 8055 - RNA, 9879 nt, Artificial Sequence
  derived and/or modified CDS sequence (opt1) from DENV-1__GU131956__SS-prME
agcgugaccaugcugcucaugcugcugcccaccgcccucgccuuccaccugacgacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaccaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugccccacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccuggugauggggcagcugaccuggaacgaccucauccgccugugcaucauggugggcgcgaacgccuccgaccgcauggggaugggcacgaccuaccuggcccucauggccaccuucaagaugcggccgauguucgccgucggccugcuguuccgccggcucaccagccgcgaggugcugcugcucacgaucgggcugucccugguggcgagcgucgagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgugucccuguucccccucugccugagcaccaccucccagaagaccaccuggcugccgguccuccugggcagcuucgggugcaagccccugacgauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacgcucaccauccugcugaaggccacccuccuggcgguguccggcguguaccccaugagcauccccgccacccuguucgucugguacuucuggcagaagaagaagcagcgguccggggugcucugggacacgcccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagacgacccccggcaccuucaagacccccgagggcgaggucggggccaucgcccuggacuucaagcccggcacgagcggguccccgaucgugaaccgggagggcaagaucgugggccuguacgggaacggcgucgugaccaccagcgggaccuacguguccgccaucgcccaggcgaaggccagccaggagggcccccuccccgagaucgaggacgaggucuucaagaagcgcaaccugacgaucauggaccugcacccggggagcggcaagacccggcgcuaccuccccgccauggugcgggaggccaucaagcgcaagcugcggacccugauccucgcgcccacccgcguggucgccuccgagauggccgaggcccugaagggcaugcccauccgcuaccagacgaccgccgucaagagcgagcacaccgggcgggagaucguggaccugaugugccacgcgaccuucacgaugcgccuccuguccccgguccgggugcccaacuacaacaugaucaucauggacgaggcccacuucaccgaccccgccagcaucgccgcccgcggcuacaucuccacccggguggggaugggcgaggcggccgccaucuucaugaccgccacgcccccggggagcgucgaggccuucccccaguccaacgcggugauccaggacgaggagcgcgacauccccgagcggagcuggaacuccggcuacgacuggaucaccgacuuccccggcaagaccgugugguucgucccgagcaucaaguccgggaacgacaucgccaacugccugcgcaagaacggcaagcgggugauccagcucagccgcaagaccuucgacacggaguaccagaagaccaagaacaacgacugggacuacguggucaccaccgacaucuccgagaugggggccaacuuccgggccgaccgcgugaucgacccccggcgcugccugaagcccgugauccugaaggacggccccgagcgggucauccucgcggggccgaugcccgugacgguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggacguacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacccugaugcuccuggcgcugaucgccguccucaccggcggggugacccuguucuuccugagcgggaaggggcucggcaagaccuccaucgggcugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagaccaccaagaaggaccucggcaucgggcacguggcggccgagaaccaccagcacgccacgaugcuggacgucgaccugcggccggccagcgccuggacccucuacgcgguggccaccaccgugaucacgcccaugaugcgccacaccaucgagaacaccaccgccaacaucucccugacggccaucgccaaccaggcggccauccugaugggccucgacaagggcuggcccaucagcaagauggacaucggggucccccugcuggcccucggcugcuacucccaggugaacccgcugacccugaccgccgcggugcucaugcuggucgcccacuacgccaucaucgggcccggccugcaggccaaggccacccgggaggcgcagaagcgcacggccgccgggaucaugaagaaccccaccguggacggcaucguggccaucgaccucgaccccgucguguacgacgccaaguucgagaagcagcugggccagaucaugcugcucauccugugcaccagccagauccugcucaugcgcaccacgugggcgcugugcgaguccaucacccuggccaccgggccgcucaccacgcugugggagggcagccccgggaaguucuggaacaccaccaucgccguguccauggccaacaucuuccggggcagcuaccuggccggcgcggggcucgccuucucccugaugaagucccugggcgggggccgccgggggaccggcgcccagggcgagacgcucggggagaaguggaagcgccagcugaaccagcuguccaagagcgaguucaacaccuacaagcggagcggcaucauggaggucgaccgcuccgaggccaaggaggggcucaagcggggcgagaccaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugacggaggucaagggguacaccaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccacgaucgaggaggggcgcacccugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacccacgagauguacugggugagcugcggcacggggaacaucgucuccgccgugaacaugaccagccgcaugcuccugaaccgguucaccauggcgcaccgcaagcccaccuacgagcgcgacguggaccugggcgccggcacgcggcacgucgccguggagcccgagguggccaaccucgacaucaucgggcagcgcaucgagaacaucaagaacgagcacaaguccaccuggcacuacgacgaggacaacccguacaagaccugggccuaccacggcagcuacgaggucaagcccuccgggagcgcguccagcauggugaacggcgugguccggcugcugaccaagcccugggacgugauccccauggucacgcagaucgccaugaccgacaccaccccguucgggcagcagcgcguguucaaggagaagguggacacgcggacgccccgggccaagcggggcaccacccagaucauggaggucacggccaaguggcucuggggcuuccugucccgcaacaagaagccccggaucugcacccgcgaggaguucacccggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacacggccgggugggacacccggaucaccgaggacgaccuccagaacgaggccaagaucaccgagaucauggagcccgagcacgcccugcuggccacgagcaucuucaagcucaccuaccagaacaaggugguccgcgugcagcgccccgcgaagaacggcaccgugauggacgucaucucccggcgcgaccagcgggggagcggccaggugggcaccuacgggcugaacacguucaccaacauggaggugcagcugauccgccagauggaguccgagggcaucuuccuccccagcgagcuggagaccccgaaccuggccgagcggguccucgacuggcuggagaagcacggggccgagcgccugaagcggauggccaucuccggcgacgacugcguggugaagcccaucgacgaccgcuucgccaccgcgcucaccgcccugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugcgcgagacggccugccugggcaagagcuacgcgcagauguggcagcucauguacuuccaccggcgcgaccugcggcuggccgccaacgccaucugcuccgcgguccccguggacugggugcccaccagccgcaccaccuggagcauccacgcccaccaccaguggaugacgaccgaggacaugcucuccgucuggaaccggguguggaucgaggagaacccguggauggaggacaagacccacgugagcuccugggaggagguccccuaccuggggaagcgcgaggaccaguggugcggcagccugaucggccucaccgcccgcgccacgugggccaccaacauccagguggcgaucaaccaggugcggcgccugaucgggaacgagaacuaccuggacuacaugaccuccaugaagcgguucaagaacgagagcgaccccgagggcgcccucugguga

SEQ ID NO: 8056 - RNA, 9879 nt, Artificial Sequence
  derived and/or modified CDS sequence (opt1) from DENV-1__GU131958__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuucgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8057 - RNA, 9879 nt, Artificial Sequence
  derived and/or modified CDS sequence (opt1) from DENV-1__GQ868499__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcggccaccgccgggagaagcgcuccguggcccuggcgccccacguggggcugggccucgagacgcggaccgagaccuggaugagcuccgagggggccuggaagcagauccagcgggucgagaccugggcccugcggcaccccggcuucacggugaucgcccuguuccucgcgcacgccaucgggaccagcaucacccagaagggcaucaucuucauccugcugaugcucgugacccccuccauggccaugcgcugcgucggcaucgggaaccgggacuucguggagggccugagcggggccacguggguggacgucgugcuggagcacggcuccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggguggggcaacgggugcggccucuucgggaagggcagccugcugacgugcgccaaguucaagugcgugaccaagcucgagggcaagaucguccaguacgagaaccugaaguacuccgugaucgugaccguccacaccggggaccagcaccaggugggcaacgagacgaccgagcacgggaccaucgcgaccaucacgccccaggcccccacgagcgagauccagcugaccgacuacggcgcccucacccuggacugcagcccccggaccgggcuggacuucaacgagaugguccuccugacgaugaaggagaaguccuggcuggugcacaagcagugguuccucgaccugccgcugcccuggaccuccggcgccagcaccagccaggagaccuggaaccgccaggaccuccuggugacguucaagaccgcccacgcgaagaagcaggaggucguggugcugggcucccaggagggggccaugcacaccgcccucaccggcgccacggagauccagaccagcgggaccaccacgaucuucgccggccaccugaagugccggcugaagauggacaagcucacccugaaggggaccuccuacgucaugugcaccggcagcuucaagcuggagaaggagguggcggagacgcagcacggcaccgugcugguccaggugaaguacgaggggaccgacgcccccugcaagauccccuucuccacccaggacgagaagggcgugacgcagaacgggcgccucaucaccgccaacccgaucgucaccgacaaggagaagcccgugaacaucgagaccgagccgcccuucggcgagagcuacaucguggucggcgccggggagaaggcgcugaagcuguccugguucaagaagggcagcuccaucgggaagauguucgaggccacggcccggggcgcccgccggauggccauccucggggacaccgcgugggacuucggcagcaucggcgggguguucaccuccgugggcaagcugguccaccagguguucgggaccgccuacggcgugcuguucagcggggucuccuggacgaugaagaucggcaucggcauccuccugaccuggcuggggcucaacagccgcuccaccagccuguccaugaccugcaucgccgugggcauggugacgcuguaccucggggucauggugcaggccgacagcggcugcgugaucaacuggaaggggcgcgagcugaagugcggcuccggcaucuucgucaccaacgaggugcacaccuggaccgagcaguacaaguuccaggccgacagcccgaagcggcugagcgcggccaucgggaaggccugggaggagggcgugugcgggauccgcuccgccacccggcucgagaacaucauguggaagcagaucagcaacgagcugaaccacauccugcucgagaacgacaugaaguucacggucguggugggcgacgccaacgggauccuggcgcagggcaagaagaugauccgcccccagcccauggagcacaaguacuccuggaaguccuggggcaaggccaagaucaucggggccgacauccagaacaccaccuucaucaucgacggccccgacaccccggagugccccgacaaccagcgggccuggaacaucugggaggucgaggacuacggguucggcaucuucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagacgugcaccuggcccaagagccacacccucugguccaacgggguccuggagagcgagaugaucauccccaagaucuacggcgggccgaucucccagcacaacuaccggcccggcuacuucacccagacggccgggcccuggcaccugggcaagcucgagcuggacuucgaccugugcgagggcaccaccgugguggucgacgagcacugcgggaaccgcggcccgagccuccggaccacgaccgugaccgggaagaucauccacgaguggugcugccgcuccugcacccugccgccccugcgguuccgcggcgaggacgggugcugguacggcauggagauccggcccgugaaggagaaggaggagaaccucguccgcagcaugguguccgccggcagcggggagguggacagcuucucccugggcauccugugcgccagcaucaugaucgaggaggucaugcggucccgcuggagccggaagaugcucaugacggggacccuggccguguuccugcuccugaucaugggccagcugaccuggaaggaccucauccgccugugcaucauggugggggcgaacgccuccgaccgcaugggcaugggcaccacguaccuggcccucauggccaccuucaagaugcggccgauguucgccgucgggcugcuguuccgccggcucaccagccgcgaggugcugcugcucaccaucggccugucccugguggcgagccucgagcugcccaacucccuggaggagcucggggacggccuggccaugggcaucaugaugcugaagcuccugacggaguuccagccccaccagcuguggaccacccuccugagccugaccuucaucaagacgacccucucccuggacuacgccuggaagaccaccgccauggcgcugagcaucgucucccucuucccccugugccugagcacgaccucccagaagaccaccuggcucccggugcugcuggggagcuucggcugcaagccccucaccauguuccugaucacggagaacaagaucugggggcggaaguccuggccccugaacgagggcaucauggccaucgggaucgucagcauccuccuguccagccugcucaagaacgacgugccccuggccggcccgcugaucgccggcgggaugcucaucgccugcuacgugaucagcggcuccagcgcggaccugucccuggagaaggucgccgaggugagcugggagcaggaggccgagcacuccgggaccagccacaacauccucguggagguccaggacgacggcaccaugaagaucaaggacgaggagcgcgacgacacccugacgauccugcucaaggccacccugcuggccguguccgggguguaccccaugagcauccccgcgacccucuucgucugguacuucuggcagaagaagaagcagcgguccggcgugcugugggacacccccagcccgcccgagguggagcgcgccguccuggacgacggcaucuaccggauccugcagcgcgggcuccugggccggucccaggugggggugggcgucuuccaggacgggguguuccacacgauguggcacgugacccgcggcgccguccugauguaccagggcaagcggcucgagcccagcugggccuccgugaagaaggaccugaucagcuacgggggcggguggcgcuuccagggcuccuggaacaccggggaggaggugcaggucaucgccguggagcccggcaagaacccgaagaacgugcagaccacgcccggcaccuucaagacccccgagggggaggucggcgcgaucgcccuggacuucaagcccgggaccagcggcuccccgaucgugaaccgggagggcaagaucguggggcucuacggcaacggggucgugacgaccagcggcaccuacguguccgccaucgcccaggccaaggcgagccaggaggggccccugcccgagaucgaggacgaggucuucaagaagcgcaaccugaccaucauggaccuccacccgggcagcggcaagacgcggcgcuaccugcccgccaucgugcgggaggccaucaagcgcaagcugcggacccucauccuggcccccacccgcguggucgcguccgagauggccgaggcccugaaggggaugcccauccgcuaccagaccacggccgucaagagcgagcacaccggccgggagaucguggaccucaugugccacgccaccuucaccaugcgccugcuguccccgguccgggugcccaacuacaacaugaucaucauggacgaggcgcacuucacggaccccgccagcaucgccgcccgcggguacaucuccacccgggugggcaugggggaggccgcggccaucuucaugaccgccacgccgcccggcagcgucgaggccuucccccaguccaacgccgugauccaggacgaggagcgcgacauccccgagcggagcuggaacuccggcuacgacuggaucacggacuuccccgggaagaccgugugguucguccccagcaucaaguccggcaacgacaucgcgaacugccuccgcaagaacgggaagcgggugauccagcugagccgcaagaccuucgacaccgaguaccagaagacgaagaacaacgacugggacuacguggucaccaccgacaucuccgagaugggcgccaacuuccgggccgaccgcgugaucgacccccggcgcugccugaagcccgugauccucaaggacgggcccgagcgggucauccuggccggcccgaugcccgugaccguggcgagcgccgcccagcgccggggccgcaucgggcggaaccagaacaaggagggcgaccaguacgucuacauggggcagccccugaacaacgacgaggaccacgcccacuggacggaggccaagaugcuccuggacaacaucaacacccccgagggcaucaucccggcgcuguucgagcccgagcgcgagaaguccgccgccaucgacggggaguaccgccuccggggcgaggcccgcaagaccuucguggagcugaugcggcgcggcgaccugcccgucuggcucagcuacaagguggccuccgagggguuccaguacagcgaccggcgcuggugcuucgacggcgagcggaacaaccaggugcuggaggagaacauggacgucgagaucuggaccaaggagggggagcgcaagaagcugcggccccgcuggcucgacgcgcggaccuacuccgacccgcuggcccugcgcgaguucaaggaguucgccgccggccggcgcagcgugagcggcgaccucauccuggagaucgggaagcugccccagcaccucacgcugcgggcccagaacgcgcuggacaaccucgugaugcugcacaacuccgagcagggcgggaaggccuaccgccacgccauggaggagcugcccgacaccaucgagacccucaugcugcuggcccucaucgcgguccugaccggcggggugacgcuguucuuccucagcggcaagggccuggggaagaccuccaucggccugcucugcgugaccgccagcuccgcccugcuguggauggccagcgucgagccccacuggaucgccgcguccaucauccucgaguucuuccugauggugcugcucaucccggagcccgaccggcagcgcacgccccaggacaaccagcuggccuacguggucaucgggcuccuguucaugauccugacgguggccgccaacgagaugggccugcucgagaccaccaagaaggaccuggggaucggccacguggccgcggagaaccaccagcacgccaccaugcuggacgucgaccuccggccggccagcgccuggacgcuguacgccguggcgaccaccgugaucacccccaugaugcgccacacgaucgagaacaccaccgccaacaucucccugaccgccaucgccaaccaggccgcgauccucaugggccuggacaagggguggcccaucagcaagauggacaucggcgucccccugcucgcccuggggugcuacucccaggugaacccgcugacgcucaccgccgccgugcugaugcuggucgcgcacuacgccaucaucggccccgggcuccaggccaaggccacccgggaggcccagaagcgcaccgcggccggcaucaugaagaaccccacgguggacggcaucguggccaucgaccuggaccccgucguguacgacgccaaguucgagaagcagcuggggcagaucaugcuccugauccugugcaccagccagauccuccugaugcgcaccaccugggcccugugcgaguccaucacgcucgcgaccggcccgcugaccacccugugggaggggagccccggcaaguucuggaacacgaccaucgccguguccauggccaacaucuuccggggcagcuaccucgccggggccggccuggcguucucccugaugaagucccucgggggcgggcgccggggcaccggcgcccagggggagacccugggcgagaaguggaagcgccagcugaaccagcucuccaagagcgaguucaacacguacaagcggagcgggaucauggaggucgaccgcuccgaggccaaggagggccugaagcgcggggagaccaccaagcacgccgugagccgcggcaccgcgaagcugcggugguucguggagcgcaaccuggucaagcccgagggcaaggugaucgaccucgggugcggccgcggcgggugguccuacuacugcgccgggcugaagaaggugaccgaggucaagggguacacgaagggcgggcccggccacgaggagccgauccccauggccaccuacggguggaaccuggugaagcuccacagcggcaaggacguguucuucaugccgcccgagaagugcgacacccugcugugcgacaucggggaguccagcccgaaccccaccaucgaggagggccgcacgcuccggguccugaagaugguggagcccuggcugcgcggcaaccaguucugcaucaagauccucaaccccuacaugccguccguggucgagacccuggagcagaugcagcggaagcacgggggcaugcuggugcgcaacccccucagccggaacuccacccacgagauguacugggugagcugcgggaccggcaacaucgucuccgccgugaacaugacgagccgcaugcugcugaaccgguucaccauggcccaccgcaagcccaccuacgagcgcgacguggaccucggcgcggggacccggcacgucgccguggagcccgagguggccaaccuggacaucaucggccagcgcaucgagaacaucaagaacgagcacaaguccacguggcacuacgacgaggacaacccguacaagaccugggccuaccacgggagcuacgaggucaagcccuccggcagcgccuccagcauggugaacggggugguccggcugcucaccaagcccugggacgugauccccauggucacccagaucgcgaugacggacaccaccccguucggccagcagcgcguguucaaggagaagguggacacccggacgccccgcgccaagcggggcaccacccagaucauggaggucaccgccaaguggcuguggggguuccugucccgcaacaagaagccccggaucugcacgcgcgaggaguucacccggaaggugcgcagcaacgccgccaucggcgcgguguucgucgacgagaaccaguggaacagcgccaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggcgaagggcucccgggccaucugguacauguggcucggggcccgcuuccuggaguucgaggcccugggcuucaugaacgaggaccacugguucagccgggagaacucccucagcgggguggagggcgaggggcugcacaagcugggcuacauccuccgcgacaucuccaagaucccgggcgggaacauguacgccgacgacaccgcgggcugggacacgcggaucaccgaggacgaccugcagaacgaggccaagaucaccgacaucauggagcccgagcacgcccugcucgccaccagcaucuucaagcugacguaccagaacaaggugguccgcgugcagcgccccgccaagaacgggaccgugauggacgucaucucccggcgcgaccagcggggcagcggccagguggggaccuacggccugaacaccuucacgaacauggaggugcagcucauccgccagauggaguccgaggggaucuuccugcccagcgagcuggagaccccgaaccucgcggagcggguccuggacuggcuggagaagcacggcgccgagcgccucaagcggauggccaucuccggggacgacugcguggugaagcccaucgacgaccgcuucgccaccgcccugaccgcgcugaacgacaugggcaagguccggaaggacaucccccagugggagcccagcaagggcuggaacgacuggcagcaggucccguucugcucccaccacuuccaccagcucaucaugaaggacgggcgcgagaucgugguccccugccggaaccaggacgagcuggugggccgcgcccgggugagccagggggccggcuggucccugcgcgagaccgccugccucggcaagagcuacgcccagauguggcagcugauguacuuccaccggcgcgaccugcggcucgcggccaacgccaucugcuccgccguccccguggacugggugcccacgagccgcaccaccuggagcauccacgcgcaccaccaguggaugaccacggaggacaugcuguccgucuggaaccggguguggaucgaggagaacccguggauggaggacaagacccacgugagcuccugggaggagguccccuaccugggcaagcgcgaggaccaguggugcggcagccucaucgggcugaccgcccgcgccaccugggccacgaacauccagguggccaucaaccaggugcggcgccugaucggcaacgagaacuaccucgacuacaugaccuccaugaagcgguucaagaacgagagcgaccccgagggggcgcugugguga

SEQ ID NO: 8058 - RNA, 9879 nt, Artificial Sequence
  derived and/or modified CDS sequence (opt1) from DENV-1__GQ868500__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggggagcucugcgaggacaccaugaccuacaagugcccccagaucaccgaggccgagcccgacgacguggacugcuggugcaacgccaccgacaccugggucaccuacgggaccugcagccagaccggggagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucggccugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacccucacgauccugcugaaggccacccuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccacgcccggcaccuucaagacccccgagggcgaggucggggccaucgcccuggacuucaagcccggcaccagcggguccccgaucgugaaccgggagggcaagaucgugggccuguacgggaacggcgucgugacgaccagcgggaccuacguguccgccaucgcccaggcgaaggccagccaggagggcccccuccccgagaucgaggacgaggucuucaagaagcgcaaccugaccaucauggaccugcacccggggagcggcaagacgcggcgcuaccuccccgccauggugcgggaggccaucaagcgcaagcugcggacccugauccucgcgcccacccgcguggucgccuccgagauggccgaggcccugaagggcaugcccauccgcuaccagaccacggccgucaagagcgagcacaccgggcgggagaucguggaccugaugugccacgcgaccuucaccaugcgccuccuguccccgguccgggugcccaacuacaacaugaucaucauggacgaggcccacuucacggaccccgccagcaucgccgcccgcggcuacaucuccacccggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucacggacuuccccggcaagaccgugugguucguccccagcaucaaguccgggaacgacaucgccaacugccugcgcaagaacggcaagcgggugauccagcucagccgcaagaccuucgacaccgaguaccagaagacgaagaacaacgacugggacuacguggucaccaccgacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccguccucaccgggggcgugacgcuguucuuccugagcgggaagggccucggcaagaccuccaucgggcugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucgugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccgucuccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugcggcugcugaccaagcccugggacgucauccccauggugaagcagaucgccaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgcgaucggggccgucuucgugggcgagaaccaguggaacagcgccaaggaggccguggaggacgagcgggucugggaccuggugcaccgcgagcgggagcuccacaagcaggggaagugcgcgaccugcguguacaacaugaugggcaagcgcgagaagaagcugggggaguucggcaaggccaagggcucccgggccaucugguacauguggcugggggcccgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgcggacgacaccgccggcugggacacccggaucacggaggacgaccuccagaacgaggccaagaucaccgagaucauggagcccgagcacgcccugcuggccaccagcaucuucaagcucaccuaccagaacaagguggugcgcguccagcgccccgcgaagaacgggacggugauggacgugaucucccggcgcgaccagcggggcagcggccaggucgggaccuacggccugaacaccuucaccaacauggaggugcagcugauccgccagauggaguccgaggggaucuuccuccccagcgagcuggagacgccgaaccuggccgagcgggugcucgacuggcuggagaagcacggcgccgagcgccugaagcggauggccaucuccggggacgacugcgucgugaagcccaucgacgaccgcuucgccaccgcgcucaccgcccugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggugcccgucgacugggugcccaccagccgcacgaccuggagcauccacgcccaccaccaguggaugaccaccgaggacaugcucuccguguggaaccgggucuggaucgaggagaacccguggauggaggacaagacgcacgugagcuccugggaggaggugcccuaccugggcaagcgcgaggaccaguggugcggcagccugaucgggcucaccgcccgcgccaccugggccaccaacauccaggucgcgaucaaccaggugcggcgccugaucggcaacgagaacuaccuggacuacaugacguccaugaagcgguucaagaacgagagcgaccccgagggggcccucugguga

SEQ ID NO: 8059 - RNA, 9879 nt, Artificial Sequence
  derived and/or modified CDS sequence (opt1) from DENV-1__GU131961__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuuccgccuggagaaggaggucgcggagacgcagcacggcaccgugcuggugcaggucaaguacgagggcaccgacgcccccugcaagauccccuucuccacccaggacgagaagggggugacgcagaacggccggcucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgggagcugaagugcggguccggcaucuucgugaccaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacgguggucgugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacaaccagcgcgccuggaacaucugggagguggaggacuacggcuucgggaucuucacgaccaacaucuggcugaagcuccgggacuccuacacccagaugugcgaccaccgccugaugagcgcggccaucaaggacuccaaggccguccacgccgacaugggcuacuggaucgagagcgagaagaacgagaccuggaagcuggcccgggcguccuucaucgaggugaagacgugcaccuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucuccgccggcagcggcgagguggacagcuucucccuggggauccugugcgccagcaucaugaucgaggaggugaugcgcucccgguggagccgcaagaugcucaugacgggcacccuggccgucuuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccguggggcugcuguuccggcgccucaccagccgggagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccgcaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgggacgacacccucacgauccugcugaaggccacccuccuggcggucuccggcguguaccccaugagcauccccgccacccuguucgugugguacuucuggcagaagaagaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacacgauguggcacgugacccgcggggccgugcugauguaccagggcaagcgccuggagcccagcugggccuccgucaagaaggaccucaucagcuacggcgggggcuggcgguuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgcgagggcaagaucgugggccuguacgggaacggcguggucacgaccagcgggaccuacguguccgccaucgcccaggcgaaggccagccaggagggcccccuccccgagaucgaggacgagguguucaagaagcggaaccugaccaucauggaccugcacccggggagcggcaagacgcgccgguaccuccccgccaucguccgcgaggccaucaagcggaagcugcgcacccugauccucgcgcccacccgcgugguggccuccgagauggccgaggcccugaagggcaugcccauccgguaccagaccacggccgucaagagcgagcacaccgggcgcgagaucguggaccugaugugccacgcgaccuucaccaugcggcuccuguccccggugcgcguccccaacuacaacaugaucaucauggacgaggcccacuucacggaccccgccagcaucgccgcccggggcuacaucuccacccgcguggggaugggcgaggcggccgccaucuucaugaccgccacgccgcccgggagcguggaggccuucccccaguccaacgcggucauccaggacgaggagcgggacauccccgagcgcagcuggaacuccggcuacgacuggaucacggacuuccccggcaagaccgugugguucgugcccagcaucaaguccgggaacgacaucgccaacugccugcggaagaacggcaagcgcgucauccagcucagccggaagaccuucgacaccgaguaccagaagacgaagaacaacgacugggacuacguggugaccaccgacaucuccgagaugggggccaacuuccgcgccgaccgggucaucgacccccgccggugccugaagcccgugauccugaaggacggccccgagcgcgugauccucgcggggccgaugcccgucaccguggccagcgccgcccagcggcgcggccggaucggccgcaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccggcugcgcggggaggcccggaagaccuucgucgagcucaugcgccggggcgaccugcccguguggcugagcuacaaggucgcguccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccgcucgcccugcgggaguucaaggaguucgccgccgggcgccggagcgucagcggcgaccugauccucgagaucggcaagcugccccagcaccugacgcuccgcgcgcagaacgcccuggacaaccuggugaugcuccacaacuccgagcagggcgggaaggccuaccggcacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccgccagcggacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcgcccggccagcgccuggacgcucuacgcggucgccaccaccgugaucacccccaugaugcggcacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgcgaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcggaccaccugggcgcugugcgaguccaucacgcuggccaccgggccgcucaccacccugugggagggcagccccgggaaguucuggaacacgaccaucgccguguccauggccaacaucuuccgcggcagcuaccuggccggcgcggggcucgccuucucccugaugaagucccugggcgggggccggcgcgggaccggcgcccagggcgagacccucggggagaaguggaagcggcagcugaaccagcuguccaagagcgaguucaacacguacaagcgcagcggcaucauggagguggaccgguccgaggccaaggaggggcucaagcgcggcgagaccaccaagcacgcggucagccgggggaccgccaagcugcgcugguucguggagcggaaccuggugaagcccgagggcaaggucaucgaccugggcugcgggcgcggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcggacgcugcgcgugcucaagauggucgagcccuggcugcggggcaaccaguucugcaucaagauccugaaccccuacaugccguccgugguggagacccucgagcagaugcagcgcaagcacggcgggaugcugguccggaacccccugagccgcaacuccacccacgagauguacugggugagcugcggcaccgggaacaucguguccgccgucaacaugacgagccggaugcuccugaaccgcuucaccauggcgcaccgcaagcccaccuucgagcgggacguggaccugggcgccggcacccgccacguggccgucgagcccgagguggccaaccucgacaucaucgggcagcggaucgagaacaucaagaacgagcacaaguccacguggcacuacgacgaggacaacccguacaagaccugggccuaccacggcagcuacgaggugaagcccuccgggagcgcguccagcauggucaacggcguggugcgccugcugaccaagcccugggacgucauccccauggugacccagaucgccaugacggacaccaccccguucgggcagcagcgggucuucaaggagaagguggacacccgcacgccccgggccaagcgcggcaccacccagaucauggaggugaccgccaaguggcucuggggcuuccugucccggaacaagaagccccgcaucugcacgcgggaggaguucacccgcaagguccggagcaacgccgcgaucggggccguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgcggacgacaccgccgggugggacacgcgcaucaccgaggacgaccuccagaacgaggccaagaucaccgacaucauggagcccgagcacgcccugcuggccaccagcaucuucaagcucacguaccagaacaagguggugcgcguccagcggcccgcgaagaacggcaccgugauggacgugaucucccgccgggaccagcgcgggagcggccaggucggcaccuacgggcugaacaccuucacgaacauggaggugcagcugauccggcagauggaguccgagggcaucuuccuccccagcgagcuggagaccccgaaccuggccgagcgcgugcucgacuggcuggagaagcacggggccgagcggcugaagcgcauggccaucuccggcgacgacugcgucgugaagcccaucgacgaccgguucgccaccgcgcucaccgcccugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcgcagauguggcagcucauguacuuccaccgccgggaccugcgccuggccgccaacgccaucugcuccgcggugcccgucgacugggugcccacgagccggaccaccuggagcauccacgcccaccaccaguggaugaccacggaggacaugcucuccguguggaaccgcgucuggaucgaggagaacccguggauggaggacaagacccacgugagcuccugggaggaggugcccuaccuggggaagcgcgaggaccaguggugcggcagccugaucggccucaccgcccgggccaccugggccacgaacauccaggucgcgaucaaccaggugcgccggcugaucgggaacgagaacuaccuggacuacaugaccuccaugaagcgcuucaagaacgagagcgaccccgagggcgugcucugguga

SEQ ID NO: 8060 - RNA, 9870 nt, Artificial Sequence
  derived and/or modified CDS sequence (opt1) from DENV-1__GU131962__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggauggggaccacguaccuggcccucauggccaccuucaagaugcggccgauguucgccgugggccugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaguacgccagcgccgggcuggccaucaucgugccccugccgcucgacacguacggccgcaaccggcugaagauccacuccggcaaggacguguucuucaugccgcccgagaagggggacacccugcucugcgacaucggcgagagcucccccaacccgaccaucgaggaggggcgcacccugcggguccugaagaugguggagcccuggcuccgcggcaaccaguucugcaucaagauccugaaccccuacaugcccagcguggucgaggcgcuggagcagaugcagcggaagcacgggggcaugcucgugcgcaacccgcugucccggaacagcacgcacgagauguacuggguguccugcggcaccgggaacaucgucagcgccgugaacaugaccucccgcaugcugcucaaccgcuucaccauggcccaccggaagcccacguacgagcgcgacguggaccugggcgccgggacccggcacgucgccguggagcccgagguggcgaaccuggacaucaucggccagcgcaucgagaacaucaagaacgagcacaagagcaccuggcacuacgacgaggacaaccccuacaagaccugggccuaccacggcuccuacgaggucaagccgagcggguccgccagcuccauggugaacggcgugguccggcuccugacgaagcccugggacgugauccccauggucacccagaucgccaugaccgacaccacgcccuucgggcagcagcgcguguucaaggagaagguggacacccggaccccgcgcgccaagcggggcaccacgcagaucauggaggucaccgcgaaguggcuguggggguuccucagccgcaacaagaagccccggaucugcacccgcgaggaguucacccggaaggugcgcagcaacgccgccaucggcgccguguucgucgacgagaaccaguggaacuccgcgaaggaggccguggaggacgagcgguucugggaccuggugcaccgcgagcgggagcugcacaagcagggcaagugcgccacgugcgucuacaacaugauggggaagcgcgagaagaagcucggcgaguucgggaaggccaagggcagccgggccaucugguacauguggcugggggcgcgcuuccuggaguucgaggcccucggcuucaugaacgaggaccacugguucucccgggagaacagccuguccggcguggagggggagggccugcacaagcucggguacauccugcgcgacaucagcaagauccccggcgggaacauguacgccgacgacaccgccggcugggacacccgcaucaccgaggacgaccugcagaacgaggccaagaucacggagaucauggagccggagcacgcgcuccuggccaccuccaucuucaagcugaccuaccagaacaaggugguccgggugcagcgccccgccaagaacggcaccgugauggacgucaucagccggcgcgaccagcggggguccggccagguggggacguacggccucaacaccuucaccaacauggaggugcagcugauccgccagauggagagcgagggcaucuuccugcccuccgagcucgagacccccaaccuggccgagcggguccuggacuggcucgagaagcacggggccgagcgccugaagcggauggcgaucagcggcgacgacugcguggugaagccgaucgacgaccgcuucgccacggcccugaccgcccucaacgacauggggaagguccggaaggacaucccccagugggagcccuccaagggcuggaacgacuggcagcagguccccuucugcagccaccacuuccaccagcugaucaugaaggacgggcgcgagaucguggucccgugccggaaccaggacgagcuggugggccgcgcccgggugucccagggcgcgggguggagccuccgcgagaccgccugccugggcaaguccuacgcccagauguggcagcugauguacuuccaccggcgcgaccuccggcuggccgcgaacgccaucugcagcgccguccccguggacugggugcccaccagccgcaccacgugguccauccacgcccaccaccaguggaugaccaccgaggacaugcugagcgucuggaaccgcguguggaucgaggagaaccccuggauggaggacaagacccacguguccagcugggaggaggucccguaccucgggaagcgggaggaccaguggugcggcucccugaucgggcugacggcccgcgcgaccugggccaccaacauccagguggccaucaaccaggugcggcgccucaucggcaacgagaacuaccuggacuacaugaccagcaugaagcgguucaagaacgaguccgaccccgagggcgcccugugguga

SEQ ID NO: 8061 - RNA, 9879 nt, Artificial Sequence
  derived and/or modified CDS sequence (opt1) from DENV-1__GU131963__SS-prME
agcgugaccaugcugcucaugcugcugcccaccgcccucgccuuccaccugaccacccggggcggggagccccacaugaucgugagcaagcaggagcggggcaagagccuccucuucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcgauccugcgcaagcucugcaucgaggccaagaucagcaacaccaccacggacucccggugcccgacccagggcgaggccacccugguggaggagcaggacgccaacuucgugugccgccggaccuucgucgaccgcggcugggggaacggcugcgggcuguucggcaaggggagccuccugacgugcgccaaguucaagugcgugaccaagcuggagggcaagaucgugcaguacgagaaccucaaguacuccgucaucgugaccgugcacaccggcgaccagcaccaggucgggaacgagacgaccgagcacggcaccaucgcgaccaucacgccccaggcccccacgagcgagauccagcugaccgacuacggggcccugacccucgacugcagcccccggaccggccuggacuucaacgagauggugcugcucacgaugaaggagaaguccuggcugguccacaagcagugguuccuggaccucccgcugcccuggaccuccggggccagcaccagccaggagaccuggaaccgccaggaccugcucgugacguucaagaccgcccacgcgaagaagcaggagguggucgugcugggcucccaggagggcgccaugcacaccgcccugaccggggccacggagauccagaccagcggcaccaccacgaucuucgccgggcaccucaagugccggcugaagauggacaagcugacccucaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccgcccuucggggagagcuacaucguggugggcgccggcgagaaggcgcucaagcuguccugguucaagaaggggagcuccaucggcaagauguucgaggccacggcccgcggggcgcgccggauggccauccugggcgacaccgcgugggacuucgggagcaucggcggcgucuucaccuccguggggaagcucgugcaccaggucuucggcaccgccuacggggugcuguucagcggcguguccuggacgaugaagaucgggaucggcauccugcucaccuggcugggccugaacagccgcuccaccagccucuccaugaccugcaucgccgucgggauggugacgcuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacgguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccugugguccaacggcgugcucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgugagcaucaugaucgaggaggucaugcggucccgcuggagccggaagaugcugaugacgggcacccucgccguguuccugcugcucgugauggggcagcugaccuggaacgaccugauccgccucugcaucauggucggcgccaacgcguccgaccgcauggggaugggcaccacguaccuggcccugauggccaccuucaagaugcggccgauguucgccgugggccuccuguuccgccggcugaccagccgcgaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccauggcccucagcaucgucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugaagaucaaggacgaggagcgcgacgacacccugacgauccuccugaaggccacccugcucgccguguccggcgucuaccccaugagcauccccgcgacccuguucgugugguacuucuggcagaagaagaagcagcgguccggggugcugugggacacccccagcccgcccgaggucgagcgcgccgugcucgacgacggcaucuaccggauccugcagcgcggccugcuggggcggucccaggugggcgucgggguguuccaggacggcguguuccacacgauguggcacgucacccgcggggccgugcucauguaccagggcaagcggcuggagcccagcugggccuccgugaagaaggaccugaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccugcccgagaucgaggacgagguguucaagaagcgcaaccucaccaucauggaccugcacccggggagcggcaagacgcggcgcuaccugcccgccaucgugcgggaggccaucaagcgcaagcuccggacccugauccuggcccccacccgcgucguggcguccgagauggccgaggcccucaagggcaugcccauccgcuaccagaccacggccgucaagagcgagcacaccgggcgggagaucgucgaccugaugugccacgccaccuucaccaugcgccugcucuccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcugagccgcaagaccuucgacaccgaguaccagaagacgaagaacaacgacugggacuacgucgugaccaccgacaucuccgagaugggggccaacuuccgggccgaccgcgugaucgacccccggcgcugccucaagcccgucauccugaaggacggccccgagcgggugauccuggccgggccgaugcccgugaccgucgcgagcgccgcccagcgccggggccgcaucggccggaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccgccugcgcggggaggcccgcaagaccuucgucgagcugaugcggcgcggcgaccuccccguguggcugagcuacaagguggccuccgagggcuuccaguacagcgaccggcgcuggugcuucgacggggagcggaacaaccagguccuggaggagaacauggacguggagaucuggaccaaggagggcgagcgcaagaagcuccggccccgcuggcuggacgcgcggaccuacuccgacccgcuggcccuccgcgaguucaaggaguucgccgccgggcggcgcagcgugagcggcgaccugauccuggagaucggcaagcucccccagcaccugacgcugcgggcccagaacgcgcucgacaaccuggucaugcugcacaacuccgagcagggcgggaaggccuaccgccacgccauggaggagcuccccgacaccaucgagacccugaugcugcucgcccugaucgcggugcugaccgggggcgugacccucuucuuccugagcgggaagggccugggcaagaccuccaucgggcuccugugcgucaccgccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucggccuccuguucaugauccugacgguggccgccaacgagauggggcuccuggagaccaccaagaaggaccugggcaucgggcacgucgccgcggagaaccaccagcacgccaccaugcucgacguggaccugcggccggccagcgccuggacgcuguacgccguggcgaccaccgucaucacccccaugaugcgccacacgaucgagaacaccaccgccaacaucucccucaccgccaucgccaaccaggccgcgauccugaugggccuggacaagggcuggcccaucagcaagauggacaucggggugccccuccuggcccugggcugcuacucccaggugaacccgcucacgcugaccgccgccguccugaugcucguggcgcacuacgccaucaucgggcccggccugcaggccaaggccacccgggaggcccagaagcgcaccgcggccgggaucaugaagaaccccacgguggacggcaucgucgccaucgaccuggaccccgugguguacgacgccaaguucgagaagcagcucggccagaucaugcugcugauccucugcaccagccagauccugcugaugcgcaccaccugggcccucugcgaguccaucacgcuggcgaccgggccgcugaccacccucugggagggcagccccgggaaguucuggaacacgaccaucgccgucuccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagagcgaguucaacacguacaagcggagcggcaucauggagguggaccgcuccgaggccaaggaggggcugaagcggggcgagaccaccaagcacgccgugagccgcgggaccgcgaagcuccggugguucgucgagcgcaaccuggugaagcccgagggcaaggugaucgaccugggcugcgggcggggcgggugguccuacuacugcgccggccugaagaaggucaccgaggugaagggguacacgaagggcggccccgggcacgaggagccgauccccauggccaccuacggcuggaaccucgugaagcugcacagcgggaaggacgucuucuucaugccgcccgagaagugcgacacccugcucugcgacaucggcgaguccagcccgaaccccaccaucgaggaggggcgcacgcugcgggugcugaagaugguggagcccuggcuccgcggcaaccaguucugcaucaagauccugaaccccuacaugccguccgucguggaggcccuggagcagaugcagcggaagcacggcgggaugcucgugcgcaacccccugagccggaacuccacccacgagauguacugggucagcugcggcaccgggaacaucguguccgccgugaacaugaccagccgcaugcugcucaaccgguucacgauggcgcaccgcaagcccaccuacgagcgcgacgucgaccugggcgccggcacccggcacguggccguggagcccgaggucgccaaccuggacaucaucgggcagcgcaucgagaacaucaagaacgagcacaaguccaccuggcacuacgacgaggacaacccguacaagacgugggccuaccacggcagcuacgaggugaagcccuccgggagcgcguccagcauggugaacggcgucgugcggcuccugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcuguggggcuuccucucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgcggacgacaccgccgggugggacacccggaucacggaggacgaccugcagaacgaggccaagaucaccgagaucauggagcccgagcacgcccuccuggccaccagcaucuucaagcugaccuaccagaacaaggucgugcgcgugcagcgccccgcgaagaacggcacggucauggacgugaucucccggcgcgaccagcgggggagcggccaggugggcaccuacgggcucaacaccuucaccaacauggagguccagcugauccgccagauggaguccgagggcaucuuccugcccagcgagcucgagacgccgaaccuggccgagcgggugcuggacuggcucgagaagcacggggccgagcgccugaagcggauggccaucuccggcgacgacugcguggucaagcccaucgacgaccgcuucgccaccgcgcugaccgcccucaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcugguggggcgcgcccgggucagccagggcgccggguggucccuccgcgagaccgccugccugggcaagagcuacgcgcagauguggcagcugauguacuuccaccggcgcgaccuccggcuggccgccaacgccaucugcuccgcggugcccguggacuggguccccaccagccgcacgaccuggagcauccacgcccaccaccaguggaugaccaccgaggacaugcuguccguguggaaccggguguggaucgaggagaacccguggauggaggacaagacgcaggucagcuccugggaggaggugcccuaccucgggaagcgcgaggaccaguggugcggcagccugaucggccugaccgcccgcgccaccugggccaccaacauccagguggcgaucaaccagguccggcgccucaucgggaacgagaacuaccuggacuacaugacguccaugaagcgguucaagaacgagagcgaccccgagggcgcccugugguga

SEQ ID NO: 8062 - RNA, 9879 nt, Artificial Sequence
  derived and/or modified CDS sequence (opt1) from DENV-1__KF955442__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgacggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuucgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8063 - RNA, 9879 nt, Artificial Sequence
  derived and/or modified CDS sequence (opt1) from DENV-1__GU131965__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgggucgagaccugggugcugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccauccuccgcaagcugugcaucgaggcgaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgccaccaucacgccccaggcgcccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgccaagaagcaggaggucguggugcugggcucccaggagggcgcgaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggccgagacgcagcacggcaccgugcugguccaggugaaguacgagggcaccgacgcgcccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcccugaagcuguccugguucaagaaggggagcuccaucggcaagauguucgaggcgacggcccgcggggcccgccggauggccauccucggcgacaccgccugggacuucgggagcaucggcggcguguucaccuccguggggaagcugguccaccagguguucggcaccgcguacggggugcuguucagcggcgucuccuggacgaugaagaucgggaucggcauccuccugaccuggcugggccucaacagccgcaacaccucccugagcaugaccugcaucgccguggggauggugacgcuguaccucggcgucauggugcaggccgacuccgggugcgugaucaacuggaagggccgcgagcugaagugcgggagcggcaucuucgucaccaacgaggugcacaccuggaccgagcaguacaaguuccaggccgacuccccgaagcggcugagcgccgcgaucggcaaggccugggaggagggggugugcggcauccgcagcgccacccggcucgagaacaucauguggaagcagaucuccaacgagcugaaccacauccugcucgagaacgacaugaaguucacggucguggugggggacgccaacggcauccuggcccaggggaagaagaugauccgcccccagcccauggagcacaaguacagcuggaaguccuggggcaaggcgaagaucaucggcgccgacauccagaacaccaccuucaucaucgacgggcccgacaccccggagugccccgacaaccagcgggccuggaacaucugggaggucgaggacuacggcuucgggaucuucacgaccaacaucuggcugaagcuccgcgacagcuacacccagaugugcgaccaccggcugauguccgccgcgaucaaggacagcaaggccgugcacgccgacaugggcuacuggaucgaguccgagaagaacgagaccuggaagcuggcccgcgccagcuucaucgaggugaagacgugcaccuggcccaagucccacacccucuggagcaacggcguccuggaguccgagaugaucauccccaagaucuacgggggcccgaucagccagcacaacuaccggcccggguacuucacccagacggcgggccccuggcaccuggggaagcucgagcuggacuucgaccugugcgagggcaccaccgugguggucgacgagcacugcggcaaccgcgggccgucccuccggaccacgaccgccaccggcaagaucauccacgaguggugcugccgcagcugcacccugccgccccugcgguuccgcggggaggacggcugcugguacgggauggagauccggcccgugaaggagaaggaggagaaccucgugcgcuccauggucagcgccggcuccggcgagguggacagcuucagccuggggauccugugcgccuccaucaugaucgaggaggugaugcggagccgcuggucccggaagaugcucaugacgggcacccuggccgucuuccugcuccuggugauggggcagcugaccuggaacgaccucauccgccugugcaucauggugggcgcgaacgccagcgaccgcauggggaugggcaccacguaccuggcccucauggccaccuucaagaugcggccgauguucgccgucgggcugcuguuccgccggcucaccucccgcgaggugcugcugcucaccaucgggcugagccugguggcguccgucgagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgccuggaagaccaccgccauggcgcuguccaucgugagccuguucccccucugccuguccacgaccagccagaagaccaccuggcugccgguccuccugggcuccuucgggugcaagccccugaccauguuccucaucacggagaacaagaucuggggccgcaagagcuggccccugaacgaggggaucauggccaucggcaucguguccauccugcucagcucccugcugaagaacgacgugccccucgccgggccgcugaucgccggcggcaugcugaucgccugcuacgucaucagcgggagcuccgcggaccucagccuggagaaggccgccgagguguccugggagcaggaggccgagcacagcggcaccucccacaacauccugguggagguccaggacgacgggaccaugaagaucaaggacgaggagcgcgacgacacccucacgauccugcugaaggccacccuccuggcggugagcggcguguaccccauguccauccccgccacccuguucgucugguacuucuggcagaagaagaagcagcggagcggggugcucugggacacccccuccccgcccgagguggagcgcgccguccuggacgacggcaucuaccggauccugcagcgcggccugcucgggcggagccaggugggcgugggggucuuccaggacggcguguuccacacgauguggcacgugacccgcggggccguccugauguaccagggcaagcggcuggagcccuccugggccagcgugaagaaggaccucaucuccuacggcgggggcuggcgcuuccaggggagcuggaacaccggcgaggaggugcaggucaucgcgguggagcccgggaagaacccgaagaacgugcagaccacgcccggcaccuucaagacccccgagggcgaggucggggccaucgcccuggacuucaagcccggcaccuccgggagcccgaucgugaaccgggagggcaagaucgugggccuguacgggaacggcgucgugacgaccuccgggaccuacgugagcgccaucgcccaggcgaaggccucccaggagggcccccuccccgagaucgaggacgaggucuucaagaagcgcaaccugaccaucauggaccugcacccggggagcggcaagacgcggcgcuaccuccccgccaucgugcgggaggccaucaagcgcaagcugcggacccugauccucgcgcccacccgcguggucgccagcgagauggccgaggcccugaagggcaugcccauccgcuaccagaccacggccgugaaguccgagcacaccgggcgggagaucguggaccugaugugccacgcgaccuucaccaugcgccuccugagcccgguccgggugcccaacuacaacaugaucaucauggacgaggcccacuucacggaccccgccuccaucgccgcccgcggcuacaucagcacccggguggggaugggcgaggcggccgccaucuucaugaccgccacgccgcccggguccgucgaggccuucccccagagcaacgcggugauccaggacgaggagcgcgacauccccgagcgguccuggaacagcggcuacgacuggaucacggacuuccccggcaagaccgugugguucguccccuccaucaagagcgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggccaacuuccgggccgaccgcgugaucgacccccggcgcugccugaagcccgugauccugaaggacggccccgagcgggucauccucgcggggccgaugcccgugaccguggccuccgccgcccagcgccggggccgcaucggccggaaccagaacaaggagggggaccaguacgucuacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcuguccuacaagguggcgagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccgcucgcccugcgcgaguucaaggaguucgccgccgggcggcgcuccgugagcggcgaccugauccucgagaucggcaagcugccccagcaccugacgcuccgggcgcagaacgcccuggacaaccuggugaugcuccacaacagcgagcagggcgggaaggccuaccgccacgccauggaggagcugcccgacaccaucgagacccugaugcuccuggcgcugaucgccguccucaccgggggcgugacgcuguucuuccuguccgggaagggccucggcaagaccagcaucgggcugcugugcgugaccgccuccagcgcccuccuguggauggccuccgucgagccccacuggaucgcggccagcaucauccuggaguucuuccucauggugcugcugaucccggagcccgaccggcagcgcacgccccaggacaaccagcucgccuacguggucaucggccugcuguucaugauccucacgguggccgccaacgagauggggcugcuggagaccaccaagaaggaccucggcaucgggcacguggcggccgagaaccaccagcacgccaccaugcuggacgucgaccugcggccggccuccgccuggacgcucuacgcgguggccaccaccgugaucacccccaugaugcgccacacgaucgagaacaccaccgccaacaucagccugaccgccaucgccaaccaggcggccauccugaugggccucgacaagggcuggcccaucuccaagauggacaucggggucccccugcuggcccucggcugcuacagccaggugaacccgcugacgcugaccgccgcggugcucaugcuggucgcccacuacgccaucaucgggcccggccugcaggccaaggccacccgggaggcgcagaagcgcaccgccgccgggaucaugaagaaccccacgguggacggcaucguggccaucgaccucgaccccgucguguacgacgccaaguucgagaagcagcugggccagaucaugcugcucauccugugcaccucccagauccugcucaugcgcaccaccugggcgcugugcgagagcaucacgcuggccaccgggccgcucaccacccugugggagggcucccccgggaaguucuggaacacgaccaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcugagcaaguccgaguucaacacguacaagcggagcggcaucauggaggucgaccgcagcgaggccaaggaggggcucaagcggggcgagaccaccaagcacgcggugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacacgaagggcggccccgggcacgaggagccgauccccauggccaccuacggcuggaaccuggugaagcugcacuccgggaaggacguguucuucaugccgcccgagaagugcgacacccuccugugcgacaucggcgagagcuccccgaaccccaccaucgaggaggggcgcacgcugcggguccucaagaugguggagcccuggcugcgcggcaaccaguucugcaucaagauccugaaccccuacaugccgagcguggucgagacccucgagcagaugcagcggaagcacggcgggaugcuggugcgcaacccccugucccggaacagcacccacgagauguacuggguguccugcggcaccgggaacaucgucagcgccgugaacaugacgucccgcaugcuccugaaccgguucaccauggcgcaccgcaagcccaccuacgagcgcgacguggaccugggcgccggcacccggcacgucgccguggagcccgagguggccaaccucgacaucaucgggcagcgcaucgagaacaucaagaacgagcacaagagcacguggcacuacgacgaggacaacccguacaagaccugggccuaccacggcuccuacgaggucaagcccagcggguccgcgagcuccauggugaacggcgugguccggcugcugaccaagcccugggacgugauccccauggucacccagaucgccaugacggacaccaccccguucgggcagcagcgcguguucaaggagaagguggacacccggacgccccgcgccaagcggggcaccacccagaucauggaggucaccgccaaguggcucuggggcuuccugagccgcaacaagaagccccggaucugcacgcgcgaggaguucacccggaaggugcgcuccaacgccgcgaucggggccguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgcggacgacaccgccgggugggacacgcggaucaccgaggacgaccuccagaacgaggccaagaucaccgagaucauggagcccgagcacgcccugcuggccaccuccaucuucaagcucacguaccagaacaaggugguccgcgugcagcgccccgcgaagaacggcaccgugauggacgucaucagccggcgcgaccagcggggguccggccaggugggcaccuacgggcugaacaccuucacgaacauggaggugcagcugauccgccagauggagagcgagggcaucuuccuccccuccgagcuggagaccccgaaccuggccgagcggguccucgacuggcuggagaagcacggggccgagcgccugaagcggauggccaucagcggcgacgacugcguggugaagcccaucgacgaccgcuucgccaccgcgcucaccgcccugaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcucguggggcgcgcccgggugucccagggcgccggguggagccugcgcgagaccgccugccugggcaaguccuacgcgcagauguggcagcucauguacuuccaccggcgcgaccugcggcuggccgccaacgccaucugcagcgcgguccccguggacugggugcccacgucccgcaccaccuggagcauccacgcccaccaccaguggaugaccacggaggacaugcucagcgucuggaaccggguguggaucgaggagaacccguggauggaggacaagacccacguguccagcugggaggagguccccuaccuggggaagcgcgaggaccaguggugcggcucccugaucggccucaccgcccgcgccaccugggccacgaacauccagguggcgaucaaccaggugcggcgccugaucgggaacgagaacuaccuggacuacaugaccagcaugaagcgguucaagaacgaguccgaccccgagggcgcccucugguga

SEQ ID NO: 8064 - RNA, 9879 nt, Artificial Sequence
  derived and/or modified CDS sequence (opt1) from DENV-1__GU131966__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguaccggcgcagcggcaucauggagguggaccgguccgaggccaaggaggggcucaagcgcggcgagaccaccaagcacgcggucagccgggggaccgccaagcugcgcugguucguggagcggaaccuggugaagcccgagggcaaggucaucgaccugggcugcgggcgcggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcggacgcugcgcgugcucaagauggucgagcccuggcugcggggcaaccaguucugcaucaagauccugaaccccuacaugccguccgugguggagacccucgagcagaugcagcgcaagcacggcgggaugcugguccggaacccccugagccgcaacuccacccacgagauguacugggugagcugcggcaccgggaacaucguguccgccgucaacaugacgagccggaugcuccugaaccgcuucaccauggcgcaccgcaagcccaccuucgagcgggacguggaccugggcgccggcacccgccacguggccgucgagcccgagguggccaaccucgacaucaucgggcagcggaucgagaacaucaagaacgagcacaaguccacguggcacuacgacgaggacaacccguacaagaccugggccuaccacggcagcuacgaggugaagcccuccgggagcgcguccagcauggucaacggcguggugcgccugcugaccaagcccugggacgucauccccauggugacccagaucgccaugacggacaccaccccguucgggcagcagcgggucuucaaggagaagguggacacccgcacgccccgggccaagcgcggcaccacccagaucauggaggugaccgccaaguggcucuggggcuuccugucccggaacaagaagccccgcaucugcacgcgggaggaguucacccgcaagguccggagcaacgccgcgaucggggccguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgcggacgacaccgccgggugggacacgcgcaucaccgaggacgaccuccagaacgaggccaagaucaccgacaucauggagcccgagcacgcccugcuggccaccagcaucuucaagcucacguaccagaacaagguggugcgcguccagcggcccgcgaagaacggcaccgugauggacgugaucucccgccgggaccagcgcgggagcggccaggucggcaccuacgggcugaacaccuucacgaacauggaggugcagcugauccggcagauggaguccgagggcaucuuccuccccagcgagcuggagaccccgaaccuggccgagcgcgugcucgacuggcuggagaagcacggggccgagcggcugaagcgcauggccaucuccggcgacgacugcgucgugaagcccaucgacgaccgguucgccaccgcgcucaccgcccugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcgcagauguggcagcucauguacuuccaccgccgggaccugcgccuggccgccaacgccaucugcuccgcggugcccgucgacugggugcccacgagccggaccaccuggagcauccacgcccaccaccaguggaugaccacggaggacaugcucuccguguggaaccgcgucuggaucgaggagaacccguggauggaggacaagacccacgugagcuccugggaggaggugcccuaccuggggaagcgcgaggaccaguggugcggcagccugaucggccucaccgcccgggccaccugggccacgaacauccaggucgcgaucaaccaggugcgccggcugaucgggaacgagaacuaccuggacuacaugaccuccaugaagcgcuucaagaacgagagcgaccccgagggcgcccucugguga

SEQ ID NO: 8065 - RNA, 9879 nt, Artificial Sequence
  derived and/or modified CDS sequence (opt1) from DENV-1__GQ868501__SS-prME
agcgugaccaugcugcucaugcugcugcccaccgcccucgccuuccaccugacgacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgugggccugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaaccagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaagaccgccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggccgucuccggcguguaccccaugagcauccccgcgacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagacgacccccggcaccuucaagacccccgagggcgaggugggggcgaucgcccuggacuucaagcccggcacgagcggguccccgaucgucaaccgggagggcaagaucgugggccuguacgggaacggcguggucaccaccagcgggaccuacguguccgccaucgcccaggccaaggcgagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcccccacccgcgugguggcguccgagauggccgaggcccugaagggcaugcccauccgcuaccagacgaccgccgucaagagcgagcacaccgggcgggagaucguggaccugaugugccacgccaccuucacgaugcgccuccuguccccggugcggguccccaacuacaacaugaucaucauggacgaggcgcacuucaccgaccccgccagcaucgccgcccgcggcuacaucuccacccggguggggaugggcgaggccgcggccaucuucaugaccgccacgcccccggggagcguggaggccuucccccaguccaacgccgucauccaggacgaggagcgcgacauccccgagcggagcuggaacuccggcuacgacuggaucaccgacuuccccggcaagaccgugugguucgugccgagcaucaaguccgggaacgacaucgcgaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgccgggccgaugcccgucacgguggcgagcgccgcccagcgccggggccgcaucggccggaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgucagcggcgaccugauccucgagaucggcaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcggugcucaccggcggggucacccuguucuuccugagcgggaaggggcucggcaagaccuccaucgggcugcugugcgugaccgccagcuccgcccuccuguggauggccagcguggagccccacuggaucgccgcguccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggccgcggagaaccaccagcacgccacgaugcuggacguggaccugcggccggccagcgccuggacccucuacgccgucgcgaccaccgugaucacgcccaugaugcgccacaccaucgagaacaccaccgccaacaucucccugacggccaucgccaaccaggccgcgauccugaugggccucgacaagggcuggcccaucagcaagauggacaucggggugccccugcuggcccucggcugcuacucccaggucaacccgcugacccugaccgccgccgugcucaugcugguggcgcacuacgccaucaucgggcccggccugcaggccaaggccacccgggaggcccagaagcgcacggcggccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccugauggccaccuacggcuggaaccuggucgagcuccacagcgggaaggacguguucuucaugccgcccgagaagugcgacacccugcugugcgacaucggcgaguccagccccaacccgacgaucgaggaggggcgcacccuccgggugcugaagauggucgagcccuggcugcgcggcaaccaguucugcaucaagauccucaaccccuacaugcccuccgugguggagacccuggagcagaugcagcggaagcacggcgggaugcugguccgcaacccgcucagccggaacuccacccacgagauguacugggugagcugcggcacggggaacaucguguccgccgucaacaugaccagccgcaugcugcugaaccgguucaccauggcccaccgcaagcccaccuucgagcgcgacguggaccucggcgcgggcacgcggcacguggccgucgagcccgagguggccaaccuggacaucaucgggcagcgcaucgagaacaucaagaacgagcacaaguccaccuggcacuacgacgaggacaaccccuacaagaccugggccuaccacggcagcuacgaggugaagccguccgggagcgccuccagcauggucaacggcguggugcggcugcucaccaagcccugggacgucauccccauggugacgcagaucgcgaugaccgacaccacccccuucgggcagcagcgcgucuucaaggagaagguggacacgcggaccccgcgcgccaagcggggcaccacccagaucauggaggugacggccaaguggcuguggggcuuccugucccgcaacaagaagccccggaucugcacccgcgaggaguucacccggaagguccgcagcaacgccgccaucggggcgguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagauccccggcggcaacauguacgccgacgacacggcggggugggacacccggaucaccgaggacgaccugcagaacgaggccaagaucaccgacaucauggagccggagcacgcccugcucgccacgagcaucuucaagcugaccuaccagaacaagguggugcgcguccagcgccccgccaagaacggcaccgugauggacgugaucucccggcgcgaccagcgggggagcggccaggucggcaccuacgggcugaacacguucaccaacauggaggugcagcucauccgccagauggaguccgagggcaucuuccugcccagcgagcuggagacccccaaccucgcggagcgggugcuggacuggcuggagaagcacggggccgagcgccucaagcggauggccaucuccggcgacgacugcgucgugaagccgaucgacgaccgcuucgccaccgcccugaccgcgcugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggucccugcgcgagacggccugccucggcaagagcuacgcccagauguggcagcugauguacuuccaccggcgcgaccugcggcucgcggccaacgccaucugcuccgccgugcccgucgacugggugcccaccagccgcaccaccuggagcauccacgcgcaccaccaguggaugacgaccgaggacaugcuguccguguggaaccgggucuggaucgaggagaaccccuggauggaggacaagacccacgugagcuccugggaggaggugccguaccuggggaagcgcgaggaccaguggugcggcagccucaucggccugaccgcccgcgccacgugggccaccaacauccaggucgccaucaaccaggugcggcgccugaucgggaacgagaacuaccucgacuacaugaccuccaugaagcgguucaagaacgagagcgaccccgagggcgcgcugugguga

SEQ ID NO: 8066 - RNA, 9879 nt, Artificial Sequence
  derived and/or modified CDS sequence (opt1) from DENV-1__HQ166035__SS-prME
agcgugaccaugcugcucaugcugcugcccaccgcccucgccuuccaccugaccacccgcggcggggagccccacaugaucguguccaagcaggagcggggcaagagccuccuguucaagaccuccgcgggggugaacaugugcacccugaucgccauggaccugggggagcucugcgaggacaccaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccggcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccggcaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccgccugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccggcucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgggagcugaagugcggguccggcaucuucgugaccaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacgguggucgugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacaaccagcgcgccuggaacaucugggagguggaggacuacggcuucgggaucuucacgaccaacaucuggcugaagcuccgggacagcuacacccagaugugcgaccaccgccugaugagcgcggccaucaaggacuccaaggccguccacgccgacaugggcuacuggaucgagagcgagaagaacgagaccuggaagcuggcccgggcguccuucaucgaggugaagacgugcaccuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucuccgccggcagcggcgagguggacagcuucucccuggggauccugugcgugagcaucaugaucgaggaggucaugcgcucccgguggagccgcaagaugcucaugacgggcacccuggccguguuccugcuccuggugauggggcagcugaccuggaacgaccucauccgccugugcaucauggucggcgccaacgcguccgaccggauggggaugggcaccacguaccuggcccucauggccaccuucaagaugcgcccgauguucgccgugggccugcuguuccggcgccucaccagccgggaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccgcaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgggacgacacccucacgauccugcugaaggccaccaugcucgccguguccggcgucuaccccaugagcauccccgcgacccccuucgugugguacuucuggcagaagaagaagcagcgcauccgggugcugugggacaccccgagcccgcccgaggucgagcgcgccgugcuggacgacgggaucuaccggauccuccagcgcggccugcugggccggagccaggugggggucggcguguuccaggacgggguguuccacacgauguggcacgucacccgcggcgccgugcugauguaccaggggaagcggcucgagcccuccugggccagcgugaagaaggaccugaucuccuacggcggcggguggcgcuuccagggcagcuggaacaccggggaggagguccaggugaucgccguggagccgggcaagaaccccaagaacguccagaccacgcccgggaccuucaagacccccgagggcgaggugggcgcgaucgcccuggacuucaagccggggaccuccggcagccccaucgugaaccgggaggagaagaucgucgggcucuacggcaacggcguggugacgaccuccgggaccuacgucagcgccaucgcccaggccaaggcgucccaggagggcccccugccggagaucgaggacgagguguucaagaagcgcaaccugaccaucauggaccuccaccccgggagcggcaagacgcggcgcuaccugcccgccaucgugcgggaggccaucaagcgcaagcugcgcacccucauccuggcccccacccgggucguggcgagcgagauggccgaggcccugaaggggaugccgauccgcuaccagaccacggccgugaaguccgagcacaccggccgggagaucgucgaccucaugugccacgccaccuucaccaugcgccugcugagccccgugcgggugcccaacuacaacaugaucaucauggacgaggcgcacuucacggaccccgccuccaucgccgcccgcggcuacaucagcacccgggucgggaugggcgaggccgcggccaucuucaugaccgccaccccgcccggguccguggaggccuucccccagagcaacgccgugauccaggacgaggagcgcgacauccccgagcgguccuggaacagcggcuacgacuggaucacggacuucccggggaagaccgucugguucgugcccuccaucaagagcggcaacgacaucgcgaacugccuccgcaagaacggcaagcgggugauccagcugucccgcaagaccuucgacaccgaguaccagaagacgaagaacaacgacugggacuacgucgugaccaccgacaucagcgagaugggggccaacuuccgggccgaccgcgugaucgacccccggcgcugccugaagcccgucauccucaaggacggcccggagcgggugauccuggccgggcccaugcccgugaccgucgcguccgccgcccagcgccggggccgcaucgggcgcaaccagaacaaggagggcgaccaguacguguacaugggccagccccugaacaacgacgaggaccacgcccacuggacggaggccaagaugcuccuggacaacaucaacaccccggaggggaucauccccgcgcuguucgagcccgagcgggagaaguccgccgccaucgacggcgaguaccgccuccgcggggaggcccgcaagaccuucgucgagcugaugcggcgcggcgaccugcccguguggcucuccuacaagguggccagcgagggguuccaguacuccgaccggcgcuggugcuucgacggcgagcggaacaaccagguccuggaggagaacauggacguggagaucuggaccaaggagggcgagcgcaagaagcugcggccgcgcuggcucgacgcgcggaccuacagcgacccccuggcccugcgcgaguucaaggaguucgccgccgggcggcgcuccgugagcggcgaccucauccuggagaucgggaagcugccccagcaccucacgcugcgggcccagaacgcgcuggacaaccucgucaugcugcacaacagcgagcagggcggcaaggccuaccgccacgccauggaggagcugcccgacaccaucgagacccucaugcugcuggcccucaucgcggugcugaccgggggcgugacgcuguucuuccucuccgggaagggccuggggaagaccagcaucggccugcucugcgucaccgccuccagcgcccugcuguggauggccuccguggagccgcacuggaucgccgcgagcaucauccucgaguucuuccugauggugcugcucauccccgagcccgaccggcagcgcaccccgcaggacaaccagcuggccuacgucgugaucggccuccucuucaugauccugacgguggccgccaacgagauggggcugcucgagaccaccaagaaggaccugggcaucgggcacgucgccgcggagaaccaccagcacgccaccaugcuggacguggaccuccggcccgccuccgccuggacgcuguacgccguggcgaccaccgucaucacccccaugaugcgccacacgaucgagaacaccaccgccaacaucagccugaccgccaucgccaaccaggccgcgauccucaugggccuggacaagggguggcccaucuccaagauggacaucggcgugccgcugcucgcccugggcugcuacagccaggugaacccccugacgcucaccgccgccguccugaugcugguggcgcacuacgccaucaucgggcccggccuccaggccaaggccacccgcgaggcccagaagcggaccgcggccgggaucaugaagaaccccacgguggacggcaucgucgccaucgaccuggacccggugguguacgacgccaaguucgagaagcagcuggggcagaucaugcuccugauccugugcaccucccagauccuccugaugcgcaccaccugggcccugugcgagagcaucacgcucgcgaccggcccccugaccacccugugggagggcucccccgggaaguucuggaacacgaccaucgccgucagcauggccaacaucuuccggggcuccuaccucgccggggccggccuggcguucagccugaugaagucccucggcgggggccgccgggggaccggcgcccagggggagacccugggcgagaaguggaagcgccagcugaaccagcucagcaaguccgaguucaacacguacaagcggagcggcaucauggagguggaccgcagcgaggccaaggaggggcugaagcggggcgagaccaccaagcacgccgugucccgcgggaccgcgaagcugcggugguucgucgagcgcaaccucgugaagcccgagggcaaggugaucgaccuggggugcggccggggcggguggagcuacuacugcgccggccugaagaaggucaccgaggugaagggguacacgaagggcgggccgggccacgaggagcccauccccauggccaccuacggcuggaaccuggugaagcuccacuccgggaaggacgucuucuucaugcccccggagaagugcgacacccugcugugcgacaucggcgagagcucccccaaccccaccaucgaggaggggcgcacgcuccgggugcugaagaugguggagcccuggcugcgcggcaaccaguucugcaucaagauccucaacccguacaugcccagcgucguggaggcccuggagcagaugcagcggaagcacgggggcaugcuggugcgcaacccccucucccggaacagcacccacgagauguacugggucuccugcggcaccgggaacaucgugagcgccgugaacaugaccucccgcaugcugcugaaccgcuucacgauggcgcaccggaagcccaccuacgagcgcgacgucgaccucggcgccgggacccggcacguggccguggagccggaggucgccaaccuggacaucaucggccagcgcaucgagaacaucaagaacgagcacaagagcaccuggcacuacgacgaggacaaccccuacaagacgugggccuaccacggcuccuacgaggugaagcccagcggguccgcgagcuccauggugaacggcgucgugcggcugcucaccaagcccugggacgucaucccgauggugacccagaucgccaugaccgacacgacccccuucgggcagcagcgcguguucaaggagaaggucgacacccggacgccccgggccaagcggggcacgacccagaucauggaggugaccgccaaguggcuguggggguuccugagccgcaacaagaagccgcggaucugcacccgcgaggaguucacgcggaaggugcgcuccaacgccgcgaucggcgccgucuucguggacgagaaccaguggaacagcgccaaggaggccguggaggacgagcgguucugggaccucguccaccgcgagcgggagcugcacaagcagggcaagugcgcgaccugcguguacaacaugauggggaagcgcgagaagaagcugggcgaguucgggaaggccaagggcagccgggccaucugguacauguggcucggggcccgcuuccuggaguucgaggcccugggcuucaugaacgaggaccacugguucucccgggagaacagccucuccggcguggagggggagggccugcacaagcugggguacauccuccgcgacaucagcaagauccccggcgggaacauguacgcggacgacaccgccggcugggacacccgcaucacggaggacgaccugcagaacgaggccaagaucaccgagaucauggagcccgagcacgcccugcucgccaccuccaucuucaagcugaccuaccagaacaaggucgugcgggugcagcgccccgcgaagaacggcacggucauggacgugaucagccggcgcgaccagcggggguccggccagguggggaccuacggccugaacaccuucaccaacauggagguccagcucauccgccagauggagagcgagggcaucuuccugccguccgagcuggagacgcccaaccucgccgagcgggugcuggacuggcuggagaagcacggggccgagcgccucaagcggauggccaucagcggcgacgacugcguggucaagcccaucgacgaccgcuucgccaccgcgcugaccgcccugaacgacauggggaaggugcggaaggacaucccccagugggagccguccaagggcuggaacgacuggcagcagguccccuucugcagccaccacuuccaccagcucaucaugaaggacgggcgcgagaucgucgugcccugccggaaccaggacgagcuggugggccgcgcccgggucucccagggcgccggguggagccugcgcgagaccgccugccucggcaaguccuacgcgcagauguggcagcugauguacuuccaccggcgcgaccugcggcucgccgccaacgccaucugcagcgcggugcccguggacugggucccgaccucccgcacgaccuggagcauccacgcccaccaccaguggaugaccaccgaggacaugcugagcguguggaaccgcguguggaucgaggagaaccccuggauggaggacaagacgcacgucuccagcugggaggaggugcccuaccuggggaagcgggaggaccaguggugcggcucccucaucgggcugaccgcccgcgccaccugggccaccaacauccagguggcgaucaaccagguccggcgccugaucggcaacgagaacuaccucgacuacaugacgagcaugaagcgguucaagaacgaguccgaccccgagggcgcccugugguga

SEQ ID NO: 8067 - RNA, 9879 nt, Artificial Sequence
  derived and/or modified CDS sequence (opt1) from DENV-1__GQ868502__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaccaucuucauccugcugaugcucgccacgcccuccauggccaugcgcugcgugggcaucggcaaccgggacuucgucgaggggcugagcggcgccaccuggguggacgugguccuggagcacggguccugcgugaccaccauggcgaagaacaagcccacgcucgacaucgagcugcugaagaccgaggugaccaaccccgccauccuccgcaagcugugcaucgaggccaagaucagcaacaccacgaccgacucccggugcccgacccagggcgaggccacccuggucgaggagcaggacgccaacuucgugugccgccggacguucguggaccgcggcugggggaacggcugcggccucuucggcaaggggagccugcugaccugcgcgaaguucaagugcgucaccaagcucgagggcaagaccgugcaguacgagaaccugaaguacuccgugaucgucacggugcacaccggcgaccagcaccagguggggaacgagaccaccgagcacggcaccaucgccacgaucacgccccaggcccccaccagcgagauccagcugaccgacuacggggcccucacgcuggacugcagcccccggaccggccuggacuucaacgagaugguccuccugaccaugaaggagaaguccuggcuggugcacaagcagugguuccucgaccugccgcugcccuggaccuccggggccagcacgagccaggagaccuggaaccgccaggaccuccuggucaccuucaagaccgcgcacgccaagaagcaggagguggugguccugggcucccaggagggcgccaugcacacggcccucaccggggccaccgagauccagaccagcggcacgaccaccaucuucgcggggcaccugaagugccggcugaagauggacaagcucacccugaagggcacguccuacgugaugugcaccgggagcuucaagcuggagaaggagguggccgagacccagcacggcaccguccugguccaggugaaguacgagggcacggacgcccccugcaagauccccuucuccacccaggacgagaagggggucacccagaacggccgccucaucaccgccaacccgaucgugacggacaaggagaagcccgugaacaucgagaccgagccgcccuucggggagagcuacaucgucgugggcgcgggcgagaaggcccugaagcuguccugguucaagaaggggagcuccaucggcaagauguucgaggccaccgcccgcggggcccgccggauggcgauccucggcgacaccgccugggacuucgggagcaucggcggcguguucacguccgucgggaagcuggugcaccagguguucggcaccgccuacgggguccuguucagcggcguguccuggaccaugaagaucgggaucggcauccuccugaccuggcugggccucaacagccgcuccacgagccuguccaugaccugcaucgccguggggauggucacccuguaccucggcgugauggugcaggccgacagcgggugcgucaucaacuggaagggccgcgagcugaagugcggguccggcaucuucgugaccaacgaggugcacaccuggacggagcaguacaaguuccaggcggacagcccgaagcggcugagcgccgccaucggcaaggccugggaggagggggucugcggcauccgcuccgccacccggcucgagaacaucauguggaagcagaucagcaacgagcugaaccacauccugcucgagaacgacaugaaguucaccgugguggucggggacgcgaacggcauccuggcccaggggaagaagaugauccgcccccagcccauggagcacaaguacuccuggaaguccuggggcaaggccaagaucaucggcgccgacauccagaacaccacguucaucaucgacgggcccgacaccccggagugccccgacaaccagcgggcguggaacaucugggagguggaggacuacggcuucgggaucuucaccaccaacaucuggcugaagcuccgcgacuccuacacgcagaugugcgaccaccggcugaugagcgccgccaucaaggacuccaaggccgugcacgccgacaugggcuacuggaucgagagcgagaagaacgagaccuggaagcuggcgcgcgccuccuucaucgaggucaagaccugcaccuggcccaagagccacacgcucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcaccacgguggucguggacgagcacugcggcaaccgcgggccgagccuccggaccaccaccgugacgggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggauccugugcgccagcaucaugaucgaggaggugaugcggucccgcuggagccggaagaugcucaugaccggcacccuggcgguguuccugcuccuggucauggggcagcugacguggaacgaccucauccgccugugcaucauggugggcgccaacgccuccgaccgcauggggaugggcaccaccuaccuggcccucauggccaccuucaagaugcggccgauguucgcgguggggcugcuguuccgccggcucacgagccgcgagguccugcugcucaccaucgggcugucccugguggccagcguggagcuccccaacucccuggaggagcugggcgacgggcucgccaugggcaucaugaugcugaagcugcucaccgaguuccagccccaccagcuguggaccacgcugcucagccugaccuucaucaagaccacccugucccucgacuacgccuggaagacgaccgcgauggcccugagcaucgucucccuguucccccucugccugagcaccaccucccagaagaccacguggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgcgugcuacgugaucagcggguccagcgccgaccucucccuggagaaggccgccgaggucagcugggagcaggaggccgagcacuccggcaccagccacaacauccugguggaggugcaggacgacgggacgaugaagaucaaggacgaggagcgcgacgacacccucaccauccugcugaaggcgacccuccuggccgucuccggcguguaccccaugagcauccccgccacgcuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggcguccgucaagaaggaccucaucagcuacggcgggggcuggcgcuuccagggguccuggaacacgggcgaggagguccaggugaucgccgucgagcccgggaagaacccgaagaacgugcagaccacccccggcaccuucaagacgcccgagggcgaggugggggccaucgcccuggacuucaagcccggcaccagcggguccccgaucgucaaccgggagggcaagaucgugggccuguacgggaacggcguggucaccaccagcgggacguacguguccgccaucgcgcaggccaaggccagccaggagggcccccuccccgagaucgaggacgagguguucaagaagcgcaaccugaccaucauggaccugcacccggggagcggcaagacccggcgcuaccuccccgccaugguccgggaggcgaucaagcgcaagcugcggacccugauccucgcccccacgcgcgugguggccuccgagauggccgaggcccugaagggcaugcccauccgcuaccagaccaccgcggucaagagcgagcacaccgggcgggagaucguggaccugaugugccacgccacguucaccaugcgccuccuguccccggugcggguccccaacuacaacaugaucaucauggacgaggcccacuucaccgaccccgccagcaucgccgcgcgcggcuacaucuccacccggguggggaugggcgaggccgccgccaucuucaugacggccacgccgcccgggagcguggaggcguucccccaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagacguucgacaccgaguaccagaagaccaagaacaacgacugggacuacguggugaccacggacaucuccgagaugggggccaacuuccgggcggaccgcgucaucgacccccggcgcugccugaagcccgugauccugaaggacggccccgagcgggugauccucgccgggccgaugcccgucaccguggccagcgccgcccagcgccggggccgcaucggccggaaccagaacaaggagggggaccaguacguguacaugggccagccccugaacaacgacgaggaccacgcgcacuggaccgaggccaagaugcugcucgacaacaucaacacccccgaggggaucaucccggcccuguucgagcccgagcgcgagaaguccgccgccaucgacggcgaguaccgccugcgcggggaggcgcgcaagaccuucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggacgaaggagggcgagcgcaagaagcugcggccccgcuggcuggacgcccggaccuacuccgacccgcucgcccugcgcgaguucaaggaguucgccgcggggcggcgcagcgucagcggcgaccugauccucgagaucggcaagcugccccagcaccugacccuccgggcccagaacgcccuggacaaccuggugaugcuccacaacuccgagcagggcgggaaggccuaccgccacgcgauggaggagcugcccgacaccaucgagacgcugaugcuccuggcccugaucgccgugcucaccgggggcgucacccuguucuuccugagcgggaagggccucggcaagaccuccaucgggcugcugugcgugacggccagcuccgcccuccuguggauggcgagcguggagccccacuggaucgccgccuccaucauccuggaguucuuccucaugguccugcugaucccggagcccgaccggcagcgcacgccccaggacaaccagcucgccuacguggugaucggccugcuguucaugauccucaccgucgccgcgaacgagauggggcugcuggagaccacgaagaaggaccucggcaucgggcacguggccgccgagaaccaccagcacgccaccaugcuggacguggaccugcggccggccagcgcguggacccucuacgccgucgccaccacggugaucacccccaugaugcgccacaccaucgagaacaccacggccaacaucucccugaccgccaucgcgaaccaggccgccauccugaugggccucgacaagggcuggcccaucagcaagauggacaucggggugccccugcuggcccucggcugcuacucccaggucaacccgcugacccugaccgcggccgugcucaugcugguggcccacuacgccaucaucgggcccggccugcaggccaaggcgacgcgggaggcccagaagcgcaccgccgccgggaucaugaagaaccccaccgucgacggcaucguggccaucgaccucgaccccguggucuacgacgcgaaguucgagaagcagcugggccagaucaugcugcucauccugugcaccagccagauccugcucaugcgcacgaccugggcccugugcgaguccaucacccuggccaccgggccgcucacgacccugugggagggcagccccgggaaguucuggaacaccaccaucgccguguccauggccaacaucuuccggggcagcuaccuggcgggcgccgggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggagguggaccgcuccgaggcgaaggaggggcucaagcggggcgagaccaccaagcacgccgucagccgcgggacggccaagcugcggugguucguggagcgcaaccuggugaagcccgagggcaaggucaucgaccugggcugcgggcggggcgggugguccuacuacugcgccggccucaagaaggugaccgaggugaagggguacaccaagggcggccccgggcacgaggagccgauccccauggccaccuacggcuggaaccuggucaagcugcacagcgggaaggacguguucuucaugccgcccgagaagugcgacacgcuccugugcgacaucggcgaguccagcccgaaccccaccaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacgcacgagauguacugggugagcugcggcaccgggaacaucguguccgcggucaacaugaccagccgcaugcuccugaaccgguucaccauggcccaccgcaagcccacguacgagcgcgacguggaccugggcgccggcacccggcacguggccgucgagcccgagguggccaaccucgacaucaucgggcagcgcaucgagaacaucaagaacgagcacaaguccaccuggcacuacgacgaggacaacccguacaagaccugggcguaccacggcagcuacgaggugaagcccuccgggagcgccuccagcauggucaacggcguggugcggcugcugacgaagcccugggacgucauccccauggugacccagaucgccaugaccgacaccacgccguucgggcagcagcgcgucuucaaggagaagguggacacccggacgccccgggccaagcggggcaccacgcagaucauggaggugaccgccaaguggcucuggggcuuccugucccgcaacaagaagccccggaucugcacccgcgaggaguucacccggaagguccgcagcaacgcggccaucggggccguguucguggacgagaaccaguggaacagcgccaaggaggcggucgaggacgagcgguucugggaccuggugcaccgcgagcgggagcuccacaagcagggcaagugcgccacgugcguguacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcgucgagggggagggccuccacaagcugggguacauccugcgcgacaucuccaagaucccgggcggcaacauguacgccgacgacaccgccgggugggacacccggaucaccgaggacgaccuccagaacgaggccaagaucacggagaucauggagcccgagcacgcccugcuggcgaccagcaucuucaagcucaccuaccagaacaagguggugcgcguccagcgccccgccaagaacggcaccgugauggacgugaucucccggcgcgaccagcgggggagcggccaggucggcacguacgggcugaacaccuucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgcgaccgcccucacggcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgcgugccugggcaagagcuacgcccagauguggcagcucauguacuuccaccggcgcgaccugcggcuggccgccaacgcgaucugcuccgccgugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucacggcccgcgccaccugggcgaccaacauccaggucgccaucaaccaggugcggcgccugaucgggaacgagaacuaccuggacuacaugaccuccaugaagcgguucaagaacgagagcgaccccgagggcgcccucugguga

SEQ ID NO: 8068 - RNA, 9879 nt, Artificial Sequence
  derived and/or modified CDS sequence (opt1) from DENV-1__GQ868503__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccagaacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggagcgcgccuccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgccaacgcguccgaccgcauggggaugggcaccacguaccuggcccucauggccaccuucaagaugcggccgauguucgccguggggcugcuguuccgccggcucaccagccgcgagguccugcugcucaccaucgggcugucccugguggccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgucagcauccugcucuccagccugcugaagaacgacgugccccucgccgggccgcugaucgccggcggcaugcugaucgccugcuacgugaucagcggguccagcgccgaccucucccuggagaaggcggccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggccgucuccggcguguaccccaugagcauccccgcgacccuguucgugugguacuucuggcagaagcggaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacacgauguggcacgugacccgcggggccgugcugauguaccagggcaagcgccuggagcccagcugggccuccgucaagaaggaccucaucagcuacggcgggggcuggcgguuccagggguccuggaacaccggcgaggagguccaggugaucgccgucgagcccgggaagaacccgaagaacgugcagaccacgcccggcaucuucaagacccccgagggcgaggugggggcgaucgcccuggacuucaagcccggcaccagcggguccccgaucgucaaccgcgagggcaagaucgugggccuguacgggaacggcguggucaccacgagcgggaccuacguguccgccaucgcccaggccaaggcgagccaggagggcccccuccccgagaucgaggacgagguguucaagaagcggaaccugaccaucauggaccugcacccggggagcggcaagacccgccgguaccuccccgccaucguccgcgaggccaucaagcggaagcugcgcacgcugauccucgcccccacccgcgugguggcguccgagauggccgaggcccugaagggcaugcccauccgguaccagaccaccgccgucaagagcgagcacacggggcgcgagaucguggaccugaugugccacgccaccuucaccaugcggcuccuguccccggugcgcguccccaacuacaacaugaucaucauggacgaggcgcacuucaccgaccccgccagcaucgccgcccggggcuacaucuccacgcgcguggggaugggcgaggccgcggccaucuucaugaccgccacgccgcccgggagcguggaggccuucccccaguccaacgccgucauccaggacgaggagcgggacauccccgagcgcagcuggaacuccggcuacgacuggaucaccgacuuccccggcaagacggugugguucgugcccagcaucaaguccgggaacgacaucgcgaacugccugcggaagaacggcaagcgcgucauccagcucagccggaagaccuucgacaccgaguaccagaagaccaagaacaacgacugggacuacguggugacgaccgacaucuccgagaugggggccaacuuccgcgccgaccgggucaucgacccccgccggugccugaagcccgugauccugaaggacggccccgagcgcgugauccucgccgggccgaugcccgucaccguggcgagcgccgcccagcggcgcggccggaucggccgcaaccagaacaaggagggggaccaguacguguacaugggccagccccugaacaacgacgaggaccacgcccacuggaccgaggccaagaugcugcucgacaacaucaacacgcccgaggggaucaucccggcgcuguucgagcccgagcgcgagaaguccgccgccaucgacggcgaguaccggcugcgcggggaggcccggaagaccuucgucgagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcgcgcaccuacuccgacccgcucgcccugcgggaguucaaggaguucgccgccgggcgccggagcgucagcggcgaccugauccucgagaucggcaagcugccccagcaccugacccuccgcgcccagaacgcgcuggacaaccuggugaugcuccacaacuccgagcagggcgggaaggccuaccggcacgccauggaggagcugcccgacacgaucgagacccugaugcuccuggcccugaucgcggugcucaccgggggcgucacccuguucuuccugagcgggaagggccucggcaagacguccaucgggcugcugugcgugaccgccagcuccgcccuccuguggauggccagcguggagccccacuggaucgccgcguccaucauccuggaguucuuccucaugguccugcugaucccggagcccgaccgccagcggacgccccaggacaaccagcucgccuacguggugaucggccugcuguucaugauccucaccgucgccgccaacgagauggggcugcuggagacgaccaagaaggaccucggcaucgggcacguggccgcggagaaccaccagcacgccaccaugcuggacguggaccugcgcccggccagcgccuggacccucuacgccgucgcgacgaccgugaucacccccaugaugcggcacaccaucgagaacacgaccgccaacaucucccugaccgccaucgccaaccaggccgcgauccugaugggccucgacaagggcuggcccaucagcaagauggacaucggggugccccugcuggcccucggcugcuacucccaggucaacccgcugacccugacggccgccgugcucaugcugguggcgcacuacgccaucaucgggcccggccugcaggccaaggccacccgcgaggcccagaagcgcaccgcggccgggaucaugaagaaccccaccgucgacggcaucguggccaucgaccucgaccccguggucuacgacgccaaguucgagaagcagcugggccagaucaugcugcucauccugugcacgagccagauccugcucaugcggaccaccugggcccugugcgaguccaucacccuggcgacggggccgcucaccacccugugggagggcagccccgggaaguucuggaacaccacgaucgccguguccauggccaacaucuuccgcggcagcuaccuggccggcgccgggcucgcguucucccugaugaagucccugggcgggggccggcgcgggaccggcgcccagggcgagacccucggggagaaguggaagcggcagcugaaccagcuguccaagagcgaguucaacaccuacaagcgcagcggcaucauggagguggaccgguccgaggccaaggaggggcucaagcgcggcgagacgaccaagcacgccgucagccgggggaccgcgaagcugcgcugguucguggagcggaaccuggugaagcccgagggcaaggucaucgaccugggcugcgggcgcggcgggugguccuacuacugcgccggccucaagaaggugaccgaggugaagggguacaccaagggcggccccgggcacgaggagccgauccccauggccacguacggcuggaaccuggucaagcugcacagcgggaaggacguguucuucaugccgcccgagaagugcgacacccuccugugcgacaucggcgaguccagcccgaaccccaccaucgaggaggggcggacccugcgcgugcucaagauggucgagcccuggcugcggggcaaccaguucugcaucaagauccugaaccccuacaugccguccgugguggagacgcucgagcagaugcagcgcaagcacggcgggaugcugguccggaacccccugagccgcaacuccacccacgagauguacugggugagcugcggcaccgggaacaucguguccgccgucaacaugaccagccggaugcuccugaaccgcuucacgauggcccaccgcaagcccaccuucgagcgggacguggaccugggcgcgggcacccgccacguggccgucgagcccgagguggccaaccucgacaucaucgggcagcggaucgagaacaucaagaacgagcacaaguccaccuggcacuacgacgaggacaacccguacaagacgugggccuaccacggcagcuacgaggugaagcccuccgggagcgccuccagcauggucaacggcguggugcgccugcugaccaagcccugggacgucauccccauggugacccagaucgcgaugaccgacacgaccccguucgggcagcagcgggucuucaaggagaagguggacacccgcacgccccgggccaagcgcggcacgacccagaucauggaggugaccgccaaguggcucuggggcuuccugucccggaacaagaagccccgcaucugcacccgggaggaguucacgcgcaagguccggagcaacgccgccaucggggcgguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgccgacgacaccgcggggugggacacccgcaucacggaggacgaccuccagaacgaggccaagaucaccgacaucauggagcccgagcacgcccugcuggccaccagcaucuucaagcucaccuaccagaacaagguggugcgcguccagcggcccgccaagaacggcacggugauggacgugaucucccgccgggaccagcgcgggagcggccaggucggcaccuacgggcugaacaccuucaccaacauggaggugcagcugauccggcagauggaguccgagggcaucuuccuccccagcgagcuggagacgccgaaccuggcggagcgcgugcucgacuggcuggagaagcacggggccgagcggcugaagcgcauggccaucuccggcgacgacugcgucgugaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcccagauguggcagcucauguacuuccaccgccgggaccugcgccuggcggccaacgccaucugcuccgccgugcccgucgacugggugcccaccagccggacgaccuggagcauccacgcgcaccaccaguggaugaccaccgaggacaugcucuccguguggaaccgcgucuggaucgaggagaacccguggauggaggacaagacgcacgugagcuccugggaggaggugcccuaccuggggaagcgcgaggaccaguggugcggcagccugaucggccucaccgcccgggccaccugggccaccaacauccaggucgccaucaaccaggugcgccggcugaucgggaacgagaacuaccuggacuacaugacguccaugaagcgcuucaagaacgagagcgaccccgagggcgcgcucugguga

SEQ ID NO: 8069 - RNA, 9879 nt, Artificial Sequence
  derived and/or modified CDS sequence (opt1) from DENV-1__GQ868504__SS-prME
agcgugaccaugcugcucaugcugcugcccaccgcccucgccuuccaccugaccacccggggcggggagccgcacaugaucgugagcaagcaggagcggggcaagagccugcuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacgcggaccgagaccuggaugagcagcgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccgugggccugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgugaagggggagcacaccggccgggagaucgucgaccugaugugccacgccaccuucaccaugcgccuccugagcccggugcgggugcccaacuacaacaugaucaucauggacgaggcgcacuucacggaccccgccuccaucgccgcccgcggguacaucagcacccgggucggcaugggggaggccgcggccaucuucaugaccgccacgccgcccggcuccguggaggccuucccccagagcaacgccgugauccaggacgaggagcgcgacauccccgagcgguccuggaacagcggcuacgacuggaucacggacuuccccgggaagaccgucugguucgugcccuccaucaagagcggcaacgacaucgcgaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggccgaccgcgugaucgacccccggcgcugccugaagcccgucauccugaaggacgggcccgagcgggugauccucgccggcccgaugcccgugaccgucgcguccgccgcccagcgccggggccgcaucgggcggaaccagaacaaggagggcgaccaguacguguacauggggcagccccugaacaacgacgaggaccacgcccacuggacggaggccaagaugcugcucgacaacaucaacacccccgagggcaucaucccggcgcuguucgagcccgagcgcgagaaguccgccgccaucgacggggaguaccgccugcggggcgaggcccgcaagaccuucgucgagcucaugcggcgcggcgaccugcccguguggcuguccuacaagguggccagcgagggguuccaguaccccgaccggcgcuggugcuucgacggcgagcggaacaaccagguccucgaggagaacauggacguggagaucuggaccaaggagggggagcgcaagaagcugcggccgcgcuggcuggacgcgcggaccuacuccgacccccucgcccugcgcgaguucaaggaguucgccgccggccggcgcagcguguccggcgaccugauccucgagaucgggaagcugccccagcaccugacgcuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccggcggggugacgcuguucuuccugagcggcaagggccucgggaagaccuccaucggccugcugugcgucaccgccagcuccgcccuccuguggauggccagcguggagccgcacuggaucgccgcguccaucauccuggaguucuuccucauggugcugcugauccccgagcccgaccggcagcgcaccccgcaggacaaccagcucgccuacgucgugaucgggcugcuguucaugauccucacgguggccgccaacgagaugggccugcuggagaccaccaagaaggaccucgggaucggccacgucgccgcggagaaccaccagcacgccaccaugcuggacguggaccugcggcccgccagcgccuggacgcucuacgccguggcgaccaccgucaucacccccaugaugcgccacacgaucgagaacaccaccgccaacaucucccugaccgccaucgccaaccaggccgcgauccugaugggccucgacaagggguggcccaucagcaagauggacaucggcgugccgcugcuggcccucgggugcuacucccaggugaacccccugacgcugaccgccgccguccucaugcugguggcgcacuacgccaucaucggccccgggcugcaggccaaggccacccgggaggcccagaagcgcaccgcggccggcaucaugaagaaccccacgguggacggcaucgucgccaucgaccucgacccggugguguacgacgccaaguucgagaagcagcuggggcagaucaugcugcucauccugugcaccagccagauccugcucaugcgcaccaccugggcccugugcgaguccaucacgcuggcgaccggcccccucaccacccugugggaggggagccccggcaaguucuggaacacgaccaucgccgucuccauggccaacaucuuccggggcagcuaccuggccggggccggccucgcguucucccugaugaagucccucgggggcgggcgccgggggaccggcgcccagggggagacccucggcgagaaguggaagcgccagcugaaccagcuguccaagagcgaguucaacacguacaagcgguccgggaucauggagguggaccgcagcgaggccaaggagggccucaagcgcggggagaccaccaagcacgccgugagccgcggcaccgcgaagcugcggugguucgucgagcgcaaccuggugaagcccgagggcaaggugaucgaccuggggugcggccgcggcgggugguccuacuacugcgccgggcucaagaaggucaccgaggugaagggguacacgaagggcgggccgggccacgaggagcccauccccauggccaccuacggguggaaccuggugaagcugcacagcggcaaggacgucuucuucaugcccccggagaagugcgacacccuccugugcgacaucggggaguccagccccaaccccaccaucgaggagggccgcacgcugcgggugcucaagaugguggagcccuggcugcgcggcaaccaguucugcaucaagauccugaacccguacaugcccuccgucguggaggcccucgagcagaugcagcggaagcacgggggcaugcuggugcgcaacccccugagccggaacuccacccacgagauguacugggucagcugcgggaccggcaacaucguguccgccgugaacaugaccagccgcaugcuccugaaccgguucacgauggcgcaccgcaagcccaccuacgagcgcgacgucgaccugggcgccgggacccggcacguggccguggagccggaggucgccaaccucgacaucaucggccagcgcaucgagaacaucaagaacgagcacaaguccaccuggcacuacgacgaggacaaccccuacaagacgugggccuaccacgggagcuacgaggugaagcccuccggcagcgcguccagcauggugaacggggucgugcggcugcugaccaagcccugggacgucaucccgauggugacccagaucgccaugaccgacacgacccccuucggccagcagcgcguguucaaggagaaggucgacacccggacgccccgggccaagcggggcacgacccagaucauggaggugaccgccaaguggcucuggggguuccugucccgcaacaagaagccgcggaucugcacccgcgaggaguucacgcggaaggugcgcagcaacgccgcgaucggcgccgucuucguggacgagaaccaguggaacuccgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaagggcagccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagauccccggcgggaacauguacgcggacgacaccgccggcugggacacccggaucacggaggacgaccuccagaacgaggccaagaucaccgagaucauggagcccgagcacgcccugcuggccaccagcaucuucaagcucaccuaccagaacaaggucgugcgcgugcagcgccccgcgaagaacgggacggucauggacgugaucucccggcgcgaccagcggggcagcggccagguggggaccuacggccugaacaccuucaccaacauggagguccagcugauccgccagauggaguccgaggggaucuuccucccgagcgagcuggagacgcccaaccuggccgagcgggugcucgacuggcuggagaagcacggcgccgagcgccugaagcggauggccaucuccggggacgacugcguggucaagcccaucgacgaccgcuucgccaccgcgcucaccgcccugaacgacaugggcaaggugcggaaggacaucccccagugggagccgagcaagggcuggaacgacuggcagcagguccccuucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcgcagauguggcagcucauguacuuccaccggcgcgaccugcggcuggccgccaacgccaucugcuccgcggugcccguggacugggucccgaccagccgcacgaccugguccauccacgcccaccaccaguggaugaccaccgaggacaugcucagcguguggaaccggguguggaucgaggagaaccccuggauggaggacaagacgcacgucagcuccugggaggaggugcccuaccugggcaagcgcgaggaccaguggugcggcagccugaucgggcucaccgcccgcgccaccugggccaccaacauccagguggcgaucaaccagguccggcgccugaucggcaacgagaacuaccuggacuacaugacguccaugaagcgguucaagaacgagagcgaccccgagggggcccucugguga

SEQ ID NO: 8070 - RNA, 9879 nt, Artificial Sequence
  derived and/or modified CDS sequence (opt1) from DENV-1__GU131967__SS-prME
agcgugaccaugcugcucaugcugcugcccaccgcccucgccuuccaccugacgacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaccugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugaccggcacccuggccguguuccugcuccuggugauggggcagcugaccuggaacgaccucauccgccugugcaucauggucggcgccaacgcguccgaccgcauggggaugggcacgaccuaccuggcccucauggccaccuucaagaugcggccgauguucgccguggggcugcuguuccgccggcucaccagccgcgaggugcugcugcucacgaucgggcugucccuggucgccagcguggagcuccccaacucccuggaggagcugggcgacgggcucgcgaugggcaucaugaugcugaagcugcucaccgaguuccagccccaccagcuguggaccacccugcucagccugacguucaucaagaccacccugucccucgacuacgccuggaagaccacggccauggcccugagcaucgucucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacgcucaccauccugcugaaggccacccuccuggccguguccggcgucuaccccaugagcauccccgcgacccuguucgugugguacuucuggcagaagaagaagcagcgguccggggugcucugggacacgcccagcccgcccgaggucgagcgcgccgugcuggacgacggcaucuaccggauccugcagcgcggccugcucgggcggucccaggugggcgucgggguguuccaggacggcguguuccacaccauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagacgacccccggcaccuucaagacccccgagggcgaggugggggcgaucgcccuggacuucaagcccggcacgagcggguccccgaucgugaaccgggagggcaagaucgucggccuguacgggaacggcguggugaccaccagcgggaccuacgucuccgccaucgcccaggccaaggcgagccaggagggcccccuccccgagaucgaggacgagguguucaagaagcgcaaccugacgaucauggaccugcacccggggagcggcaagacccggcgcuaccuccccgccaucgugcgggaggccaucaagcgcaagcugcggacccugauccucgcccccacccgcgucguggcguccgagauggccgaggcccugaagggcaugcccauccgcuaccagacgaccgccgucaagagcgagcacaccgggcgggagaucgucgaccugaugugccacgccaccuucacgaugcgccuccuguccccggugcgggugcccaacuacaacaugaucaucauggacgaggcgcacuucaccgaccccgccagcaucgccgcccgcggcuacaucuccacccgggucgggaugggcgaggccgcggccaucuucaugaccgccacgcccccggggagcguggaggccuucccccaguccaacgccgugauccaggacgaggagcgcgacauccccgagcggagcuggaacuccggcuacgacuggaucaccgacuuccccggcaagaccgucugguucgugccgagcaucaaguccgggaacgacaucgcgaacugccugcgcaagaacggcaagcgggugauccagcucagccgcaagaccuucgacacggaguaccagaagaccaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugacggucgcgagcgccgcccagcgccggggccgcaucggccggaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgugagcggcgaccugauccucgagaucggcaagcugccccagcaccugacccuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccggcggggugacccuguucuuccugagcgggaaggggcucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagaccaccaagaaggaccucggcaucgggcacgucgccgcggagaaccaccagcacgccacgaugcuggacguggaccugcggccggccagcgccuggacccucuacgccguggcgaccaccgucaucacgcccaugaugcgccacaccaucgagaacaccaccgccaacaucucccugacggccaucgccaaccaggccgcgauccugaugggccucgacaagggcuggcccaucagcaagauggacaucggggugccccugcuggcccucggcugcuacucccaggugaacccgcugacccugaccgccgccguccucaugcugguggcgcacuacgccaucaucgggcccggccugcaggccaaggccacccgggaggcccagaagcgcacggcggccgggaucaugaagaaccccaccguggacggcaucgucgccaucgaccucgaccccgugguguacgacgccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccgucuccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucacggaggugaagggguacaccaagggcggccccgggcacggcgagccgaucccccuggccaccuacggguggaaccuggugaagcuccacagcggcaaggacgucuucuucaugccgcccgagaagugcgacacccugcugugcgacaucggggaguccagcccgaaccccacgaucgaggagggccgcacccuccgggugcugaagaugguggagcccuggcugcgcggcaaccaguucugcaucaagauccucaaccccuacaugccguccgucguggaggcccuggagcagaugcagcggaagcacgggggcaugcuggugcgcaacccccucagccggaacuccacccacgagauguacugggucagcugcgggaccggcaacaucguguccgccgugaacaugacgagccgcaugcugcugaaccgguucaccauggcgcaccgcaagcccaccuacgagcgcgacgucgaccucggcgccgggacccggcacguggccguggagcccgaggucgccaaccuggacaucaucggccagcgcaucgagaacaucaagaacgagcacaaguccacguggcacuacgacgaggacaacccguacaagaccugggccuaccacgggagcuacgaggugaagcccuccggcagcgcguccagcauggugaacggggucgugcggcugcucaccaagcccugggacgucauccccauggugacccagaucgccaugacggacaccaccccguucggccagcagcgcguguucaaggagaaggucgacacccggacgccccgcgccaagcggggcaccacccagaucauggaggugaccgccaaguggcuguggggguuccugucccgcaacaagaagccccggaucugcacgcgcgaggaguucacccggaaggugcgcagcaacgccgcgaucggcgccgucuucguggacgagaaccaguggaacagcgccaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaagggcucccgggccaucugguacauguggcucggggcccgcuuccuggaguucgaggcccugggcuucaugaacgaggaccacugguucagccgggagaacucccucagcgggguggagggcgaggggcugcacaagcugggcuacauccuccgcgacaucuccaagaucccgggcgggaacauguacgcggacgacaccgccggcugggacacgcggaucaccgaggacgaccugcagaacgaggccaagaucaccgagaucauggagcccgagcacgcccugcucgccaccagcaucuucaagcugacguaccagaacaaggucgugcgcgugcagcgccccgcgaagaacgggaccgucauggacgugaucucccggcgcgaccagcggggcagcggccagguggggaccuacggccugaacaccuucacgaacauggagguccagcucauccgccagauggaguccgaggggaucuuccugcccagcgagcuggagaccccgaaccucgccgagcgggugcuggacuggcuggagaagcacggcgccgagcgccucaagcggauggccaucuccggggacgacugcguggucaagcccaucgacgaccgcuucgccaccgcgcugaccgcccugaacgacaugggcaaggugcggaaggacaucccccagugggagcccagcaagggcuggaacgacuggcagcaggucccguucugcucccaccacuuccaccagcucaucaugaaggacgggcgcgagaucgucgugcccugccggaaccaggacgagcuggugggccgcgcccgggucagccagggggccggcuggucccugcgcgagaccgccugccucggcaagagcuacgcgcagauguggcagcugauguacuuccaccggcgcgaccugcggcucgccgccaacgccaucugcuccgcggugcccguggacuggguccccacgagccgcaccaccuggagcauccacgcccaccaccaguggaugaccacggaggacaugcuguccguguggaaccggguguggaucgaggagaacccguggauggaggacaagacccacgucagcuccugggaggaggugcccuaccugggcaagcgcgaggaccaguggugcggcagccucaucgggcugaccgcccgcgccaccugggccacgaacauccagguggcgaucaaccagguccggcgccugaucggcaacgagaacuaccucgacuacaugaccuccaugaagcgguucaagaacgagagcgaccccgagggggcccugugguga

SEQ ID NO: 8071 - RNA, 9879 nt, Artificial Sequence
  derived and/or modified CDS sequence (opt1) from DENV-1__GU131968__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccagaacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggagcgcgccuccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgccaacgcguccgaccgcauggggaugggcaccacguaccuggcccucauggccaccuucaagaugcggccgauguucgccguggggcugcuguuccgccggcucaccagccgcgagguccugcugcucaccaucgggcugucccugguggccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgucagcauccugcucuccagccugcugaagaacgacgugccccucgccgggccgcugaucgccggcggcaugcugaucgccugcuacgugaucagcggguccagcgccgaccucucccuggagaaggcggccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggccgucuccggcguguaccccaugagcauccccgcgacccuguucgugugguacuucuggcagaagcggaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacacgauguggcacgugacccgcggggccgugcugauguaccagggcaagcgccuggagcccagcugggccuccgucaagaaggaccucaucagcuacggcgggggcuggcgguuccagggguccuggaacaccggcgaggagguccaggugaucgccgucgagcccgggaagaacccgaagaacgugcagaccacgcccggcaccuucaagacccccgagggcgaggugggggcgaucgcccuggacuucaagcccggcaccagcggguccccgaucgucaaccgcgagggcaagaucgugggccuguacgggaacggcguggucacgaccagcgggaccuacguguccgccaucgcccaggccaaggcgagccaggagggcccccuccccgagaucgaggacgagguguucaagaagcggaaccugaccaucauggaccugcacccggggagcggcaagacgcgccgguaccuccccgccaucguccgcgaggccaucaagcggaagcugcgcacccugauccucgcccccacccgcgugguggcguccgagauggccgaggcccugaagggcaugcccauccgguaccagaccacggccgucaagagcgagcacaccgggcgcgagaucguggaccugaugugccacgccaccuucaccaugcggcuccuguccccggugcgcguccccaacuacaacaugaucaucauggacgaggcgcacuucacggaccccgccagcaucgccgcccggggcuacaucuccacccgcguggggaugggcgaggccgcggccaucuucaugaccgccacgccgcccgggagcguggaggccuucccccaguccaacgccgucauccaggacgaggagcgggacauccccgagcgcagcuggaacuccggcuacgacuggaucacggacuuccccggcaagaccgugugguucgugcccagcaucaaguccgggaacgacaucgcgaacugccugcggaagaacggcaagcgcgucauccagcucagccggaagaccuucgacaccgaguaccagaagacgaagaacaacgacugggacuacguggugaccaccgacaucuccgagaugggggccaacuuccgcgccgaccgggucaucgacccccgccggugccugaagcccgugauccugaaggacggccccgagcgcgugauccucgccgggccgaugcccgucaccguggcgagcgccgcccagcggcgcggccggaucggccgcaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccggcugcgcggggaggcccggaagaccuucgucgagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcgcgcaccuacuccgacccgcucgcccugcgggaguucaaggaguucgccgccgggcgccggagcgucagcggcgaccugauccucgagaucggcaagcugccccagcaccugacgcuccgcgcccagaacgcgcuggacaaccuggugaugcuccacaacuccgagcagggcgggaaggccuaccggcacgccauggaggagcugcccgacaccaucgagacccugaugcuccuggcccugaucgcggugcucaccgggggcgucacgcuguucuuccugagcgggaagggccucggcaagaccuccaucgggcugcugugcgugaccgccagcuccgcccuccuguggauggccagcguggagccccacuggaucgccgcguccaucauccuggaguucuuccucaugguccugcugaucccggagcccgaccgccagcggacgccccaggacaaccagcucgccuacguggugaucggccugcuguucaugauccucacggucgccgccaacgagauggggcugcuggagaccaccaagaaggaccucggcaucgggcacguggccgcggagaaccaccagcacgccaccaugcuggacguggaccugcgcccggccagcgccuggacgcucuacgccgucgcgaccaccgugaucacccccaugaugcggcacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggucaacccgcugacgcugaccgccgccgugcucaugcugguggcgcacuacgccaucaucgggcccggccugcaggccaaggccacccgcgaggcccagaagcgcaccgcggccgggaucaugaagaaccccacggucgacggcaucguggccaucgaccucgaccccguggucuacgacgccaaguucgagaagcagcugggccagaucaugcugcucauccugugcaccagccagauccugcucaugcggaccaccugggcccugugcgaguccaucacgcuggcgaccgggccgcucaccacccugugggagggcagccccgggaaguucuggaacacgaccaucgccguguccauggccaacaucuuccgcggcagcuaccuggccggcgccgggcucgcguucucccugaugaagucccugggcgggggccggcgcgggaccggcgcccagggcgagacccucggggagaaguggaagcggcagcugaaccagcuguccaagagcgaguucaacacguacaagcgcagcggcaucauggagguggaccgguccgaggccaaggaggggcucaagcgcggcgagaccaccaagcacgccgucagccgggggaccgcgaagcugcgcugguucguggagcggaaccuggugaagcccgagggcaaggucaucgaccugggcugcgggcgcggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcggacgcugcgcgugcucaagauggucgagcccuggcugcggggcaaccaguucugcaucaagauccugaaccccuacaugccguccgugguggagacccucgagcagaugcagcgcaagcacggcgggaugcugguccggaacccccugagccgcaacuccacccacgagauguacugggugagcugcggcaccgggaacaucguguccgccgucaacaugacgagccggaugcuccugaaccgcuucaccauggcccaccgcaagcccaccuucgagcgggacguggaccugggcgcgggcacccgccacguggccgucgagcccgagguggccaaccucgacaucaucgggcagcggaucgagaacaucaagaacgagcacaaguccacguggcacuacgacgaggacaacccguacaagaccugggccuaccacggcagcuacgaggugaagcccuccgggagcgccuccagcauggucaacggcguggugcgccugcugaccaagcccugggacgucauccccauggugacccagaucgcgaugacggacaccaccccguucgggcagcagcgggucuucaaggagaagguggacacccgcacgccccgggccaagcgcggcaccacccagaucauggaggugaccgccaaguggcucuggggcuuccugucccggaacaagaagccccgcaucugcacgcgggaggaguucacccgcaagguccggagcaacgccgccaucggggcgguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgccgacgacaccgcggggugggacacgcgcaucaccgaggacgaccuccagaacgaggccaagaucaccgacaucauggagcccgagcacgcccugcuggccaccagcaucuucaagcucacguaccagaacaagguggugcgcguccagcggcccgccaagaacggcaccgugauggacgugaucucccgccgggaccagcgcgggagcggccaggucggcaccuacgggcugaacaccuucacgaacauggaggugcagcugauccggcagauggaguccgagggcaucuuccuccccagcgagcuggagaccccgaaccuggcggagcgcgugcucgacuggcuggagaagcacggggccgagcggcugaagcgcauggccaucuccggcgacgacugcgucgugaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcccagauguggcagcucauguacuuccaccgccgggaccugcgccuggcggccaacgccaucugcuccgccgugcccgucgacugggugcccacgagccggaccaccuggagcauccacgcgcaccaccaguggaugaccacggaggacaugcucuccguguggaaccgcgucuggaucgaggagaacccguggauggaggacaagacccacgugagcuccugggaggaggugcccuaccuggggaagcgcgaggaccaguggugcggcagccugaucggccucaccgcccgggccaccugggccacgaacauccaggucgccaucaaccaggugcgccggcugaucgggaacgagaacuaccuggacuacaugaccuccaugaagcgcuucaagaacgagagcgaccccgagggcgcgcucugguga

SEQ ID NO: 8072 - RNA, 9879 nt, Artificial Sequence
  derived and/or modified CDS sequence (opt1) from DENV-1__GQ868506__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgggucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcgauccugcgcaagcucugcaucgaggccaagaucagcaacaccaccacggacucccggugcccgacccagggcgaggccacccugguggaggagcaggacgccaacuucgugugccgccggaccuucgucgaccgcggcugggggaacggcugcgggcuguucggcaaggggagccuccugacgugcgccaaguucaagugcgugaccaagcuggagggcaagaucgugcaguacgagaaccucaaguacuccgucaucgugaccgugcacaccggcgaccagcaccaggucgggaacgagacgaccgagcacggcaccaucgcgaccaucacgccccaggcccccacgagcgagauccagcugaccgacuacggggcccugacccucgacugcagcccccggaccggccuggacuucaacgagauggugcugcucacgaugaaggagaaguccuggcugguccacaagcagugguuccuggaccucccgcugcccuggaccuccggggccagcaccagccaggagaccuggaaccgccaggaccugcucgugacguucaagaccgcccacgcgaagaagcaggagguggucgugcugggcucccaggagggcgccaugcacaccgcccugaccggggccacggagauccagaccagcggcaccaccacgaucuucgccgggcaccucaagugccggcugaagauggacaagcugacccucaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccgcccuucggggagagcuacaucguggugggcgccggcgagaaggcgcucaagcuguccugguucaagaaggggagcuccaucggcaagauguucgaggccacggcccgcggggcgcgccggauggccauccugggcgacaccgcgugggacuucgggagcaucggcggcgucuucaccuccguggggaagcucgugcaccaggucuucggcaccgccuacggggugcuguucagcggcguguccuggacgaugaagaucgggaucggcauccugcucaccuggcugggccugaacagccgcuccaccagccucuccaugaccugcaucgccgucgggauggugacgcuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacgguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccugugguccaacggcgugcucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgugagcaucaugaucgaggaggucaugcggucccgcuggagccggaagaugcugaugacgggcacccucgccguguuccugcugcucgugauggggcagcugaccuggaacgaccugauccgccucugcaucauggucggcgccaacgcguccgaccgcauggggaugggcaccacguaccuggcccugauggccaccuucaagaugcggccgauguucgccgugggccuccuguuccgccggcugaccagccgcgaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccauggcccucagcaucgucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugaagaucaaggacgaggagcgcgacgacacccugacgauccuccugaaggccacccugcucgccguguccggcgucuaccccaugagcauccccgcgacccuguucgugugguacuucuggcagaagaagaagcagcgguccggggugcugugggacacccccagcccgcccgaggucgagcgcgccgugcucgacgacggcaucuaccggauccugcagcgcggccugcuggggcggucccaggugggcgucgggguguuccaggacggcguguuccacacgauguggcacgucacccgcggggccgugcucauguaccagggcaagcggcuggagcccagcugggccuccgugaagaaggaccugaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccugcccgagaucgaggacgagguguucaagaagcgcaaccucaccaucauggaccugcacccggggagcggcaagacgcggcgcuaccugcccgccaucgugcgggaggccaucaagcgcaagcuccggacccugauccuggcccccacccgcgucguggcguccgagauggccgaggcccucaagggcaugcccauccgcuaccagaccacggccgucaagagcgagcacaccgggcgggagaucgucgaccugaugugccacgccaccuucaccaugcgccugcucuccccgggccgggugcccaacuacaacaugaucaucauggacgaggcgcacuucacggaccccgccagcaucgccgcccgcggguacaucuccacccgggugggcaugggggaggccgcggccaucuucaugaccgccacgccgcccggcagcgucgaggccuucccccaguccaacgccgugauccaggacgaggagcgcgacauccccgagcggagcuggaacuccggcuacgacuggaucacggacuuccccgggaagaccgugugguucguccccagcaucaaguccggcaacgacaucgcgaacugccugcgcaagaacgggaagcgggugauccagcugagccgcaagaccuucgacaccgaguaccagaagacgaagaacaacgacugggacuacguggucaccaccgacaucuccgagaugggcgccaacuuccgggccgaccgcgugaucgacccccggcgcugccucaagcccgugauccugaaggacgggcccgagcgggucauccuggccggcccgaugcccgugaccguggcgagcgccgcccagcgccggggccgcaucgggcggaaccagaacaaggagggcgaccaguacgucuacauggggcagccccucaacaacgacgaggaccacgcccacuggacggaggccaagaugcugcuggacaacaucaacacccccgagggcaucaucccggcccucuucgagcccgagcgcgagaaguccgccgccaucgacggggaguaccgccugcggggcgaggcccgcaagaccuucguggagcugaugcggcgcggcgaccuccccgucuggcugagcuacaagguggccuccgagggguuccaguacagcgaccggcgcuggugcuucgacggcgagcggaacaaccaggugcuggaggagaacauggacgucgagaucuggaccaaggagggggagcgcaagaagcuccggccccgcuggcuggacgcgcggaccuacuccgacccgcuggcccuccgcgaguucaaggaguucgccgccggccggcgcagcgugagcggcgaccugauccuggagaucgggaagcucccccagcaccugacgcugcgggcccagaacgcgcucgacaaccuggugaugcugcacaacuccgagcagggcgggaaggccuaccgccacgccauggaggagcuccccgacaccaucgagacccugaugcugcucgcccugaucgcgguccugaccggcggggugacccucuucuuccugagcggcaagggccuggggaagaccuccaucggccuccugugcgugaccgccagcuccgcccugcucuggauggccagcgucgagccccacuggaucgccgcguccaucauccuggaguucuuccugauggugcuccugaucccggagcccgaccggcagcgcacgccccaggacaaccagcuggccuacguggucaucgggcuccuguucaugauccugacgguggccgccaacgagaugggccuccuggagaccaccaagaaggaccuggggaucggccacguggccgcggagaaccaccagcacgccaccaugcucgacgucgaccugcggccggccagcgccuggacgcuguacgccguggcgaccaccgugaucacccccaugaugcgccacacgaucgagaacaccaccgccaacaucucccucaccgccaucgccaaccaggccgcgauccugaugggccuggacaagggguggcccaucagcaagauggacaucggcgucccccuccuggcccuggggugcuacucccaggugaacccgcucacgcugaccgccgccgugcugaugcucgucgcgcacuacgccaucaucggccccgggcugcaggccaaggccacccgggaggcccagaagcgcaccgcggccggcaucaugaagaaccccacgguggacggcaucguggccaucgaccuggaccccgucguguacgacgccaaguucgagaagcagcucgggcagaucaugcugcugauccucugcaccagccagauccugcugaugcgcaccaccugggcccucugcgaguccaucacgcuggcgaccggcccgcugaccacccucugggaggggagccccggcaaguucuggaacacgaccaucgccguguccauggccaacaucuuccggggcagcuaccuggccggggccggccuggcguucucccucaugaagucccucgggggcgggcgccgggggaccggcgcccagggggagacccugggcgagaaguggaagcgccagcucaaccagcuguccaagagcgaguucaacacguacaagcggagcgggaucauggaggucgaccgcuccgaggccaaggagggccugaagcgcggggagaccaccaagcacgccgugagccgcggcaccgcgaagcuccggugguucguggagcgcaaccuggucaagcccgagggcaaggugaucgaccuggggugcggccgcgggggcugguccuacuacugcgccgggcugaagaaggugaccgaggucaagggcuacacgaagggcgggcccggccacgaggagccgauccccauggccaccuacggguggaaccucgugaagcugcacagcggcaaggacguguucuucaugccgcccgagaagugcgacacccugcucugcgacaucggggaguccagcccgaaccccaccaucgaggagggccgcacgcugcggguccugaagaugguggagcccuggcuccgcggcaaccaguucugcaucaagauccugaaccccuacaugccguccguggucgaggcccuggagcagaugcagcggaagcacgggggcaugcucgugcgcaacccccugagccggaacuccacccacgagauguacugggugagcugcgggaccggcaacaucgucuccgccgugaacaugaccagccgcaugcugcucaaccgguucacgauggcgcaccgcaagcccaccuacgagcgcgacguggaccugggcgccgggacccggcacgucgccguggagcccgagguggccaaccuggacaucaucggccagcgcaucgagaacaucaagaacgagcacaaguccaccuggcacuacgacgaggacaacccguacaagacgugggccuaccacgggagcuacgaggucaagcccuccggcagcgcguccagcauggugaacggggugguccggcuccugaccaagcccugggacgugauccccauggucacccagaucgccaugaccgacacgaccccguucggccagcagcgcguguucaaggagaagguggacacccggacgccccgggccaagcggggcacgacccagaucauggaggucaccgccaaguggcuguggggguuccucucccgcaacaagaagccccggaucugcacccgcgaggaguucacgcggaaggugcgcagcaacgccgcgaucggcgccguguucgucgacgagaaccaguggaacagcgccaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgcggacgacaccgccggcugggacacccggaucacggaggacgaccugcagaacgaggccaagaucaccgagaucauggagcccgagcacgcccuccuggccaccagcaucuucaagcugaccuaccagaacaaggugguccgcgugcagcgccccgcgaagaacgggacggugauggacgucaucucccggcgcgaccagcggggcagcggccagguggggaccuacggccucaacaccuucaccaacauggaggugcagcugauccgccagauggaguccgaggggaucuuccugcccagcgagcucgagacgccgaaccuggccgagcggguccuggacuggcucgagaagcacggcgccgagcgccugaagcggauggccaucuccggggacgacugcguggugaagcccaucgacgaccgcuucgccaccgcgcugaccgcccucaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcgcagauguggcagcugauguacuuccaccggcgcgaccuccggcuggccgccaacgccaucugcuccgcgguccccguggacugggugcccaccagccgcacgaccuggagcauccacgcccaccaccaguggaugaccaccgaggacaugcuguccgucuggaaccggguguggaucgaggagaacccguggauggaggacaagacgcacgugagcuccugggaggagguccccuaccucggcaagcgcgaggaccaguggugcggcagccugaucgggcugaccgcccgcgccaccugggccaccaacauccagguggcgaucaaccaggugcggcgccucaucggcaacgagaacuaccuggacuacaugacguccaugaagcgguucaagaacgagagcgaccccgagggggcccugugguga

SEQ ID NO: 8073 - RNA, 9879 nt, Artificial Sequence
  derived and/or modified CDS sequence (opt1) from DENV-1__GQ868507__SS-prME
agcgugaccaugcugcucaugcugcugcccaccgcccucgccuuccaccugaccacccggggcggggagccgcacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccaugcccggcaccuucaagacgcccgagggcgaggucggggccaucgcccuggacuucaagcccggcaccagcggguccccgaucgugaaccgggagggcaagaucgugggccuguacgggaacggcgucgugaccaccagcgggacguacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccauggugcgggaggccaucaagcgcaagcugcggacccugauccucgcgcccacgcgcguggucgccuccgagauggccgaggcccugaagggcaugcccauccgcuaccagaccaccgccgucaagagcgagcacaccgggcgggagaucguggaccugaugugccacgcgacguucaccaugcgccuccuguccccgguccgggugcccaacuacaacaugaucaucauggacgaggcccacuucaccgaccccgccagcaucgccgcccgcggcuacaucuccacccggguggggaugggcgaggcggccgccaucuucaugacggccacgccgcccgggagcgucgaggccuucccccaguccaacgcggugauccaggacgaggagcgcgacauccccgagcggagcuggaacuccggcuacgacuggaucaccgacuuccccggcaagaccgugugguucguccccagcaucaaguccgggaacgacaucgccaacugccugcgcaagaacggcaagcgggugauccagcucagccgcaagacguucgacaccgaguaccagaagaccaagaacaacgacugggacuacguggucaccacggacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagacguucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacgcugaugcuccuggcgcugaucgccguccucaccgggggcgugacccuguucuuccugagcgggaagggccucggcaagaccuccaucgggcugcugugcgugacggccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagaccacgaagaaggaccucggcaucgggcacguggcggccgagaaccaccagcacgccaccaugcuggacgucgaccugcggccggccagcgccuggacccucuacgcgguggccaccacggugaucacccccaugaugcgccacaccaucgagaacaccacggccaacaucucccugaccgccaucgccaaccaggcggccauccugaugggccucgacaagggcuggcccaucagcaagauggacaucggggucccccugcuggcccucggcugcuacucccaggugaacccgcugacccugaccgccgcggugcucaugcuggucgcccacuacgccaucaucgggcccggccugcaggccaaggccacgcgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcaccagccagauccugcucaugcgcacgaccugggcgcugugcgaguccaucacccuggccaccgggccgcucacgacccugugggagggcagccccgggaaguucuggaacaccaccaucgccguguccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagaccacgaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccaccuacggcuggaaccuggugaagcugcccagcgggaaggacguguucuucaugcccccggagaagugcgacacgcuccugugcgacaucggcgaguccagccccaaccccaccaucgaggaggggcgcacccugcggguccucaagaugguggagcccuggcugcgcggcaaccaguucugcaucaagauccugaacccguacaugcccuccguggucgagacccucgagcagaugcagcggaagcacggcgggaugcuggugcgcaacccccugagccggaacuccacgcacgagauguacugggugagcugcggcaccgggaacaucgucuccgccgugaacaugaccagccgcaugcuccugaaccgguucaccauggcgcaccgcaagcccacguacgagcgcgacguggaccugggcgccggcacccggcacgucgccguggagccggagguggccaaccucgacaucaucgggcagcgcaucgagaacaucaagaacgagcacaaguccaccuggcacuacgacgaggacaaccccuacaagaccugggccuaccacggcagcuacgaggucaagcccuccgggagcgcguccagcauggugaacggcgugguccggcugcugacgaagcccugggacgugaucccgauggucacccagaucgccaugaccgacaccacgcccuucgggcagcagcgcguguucaaggagaagguggacacccggacgccccgggccaagcggggcaccacgcagaucauggaggucaccgccaaguggcucuggggcuuccugucccgcaacaagaagccgcggaucugcacccgcgaggaguucacccggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgacgugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgcggacgacaccgccgggugggacacccggaucaccgaggacgaccuccagaacgaggccaagaucacggagaucauggagcccgagcacgcccugcuggccaccagcaucuucaagcucaccuaccagaacaaggugguccgcgugcagcgccccgcgaagaacggcaccgugauggacgucaucucccggcgcgaccagcgggggagcggccaggugggcacguacgggcugaacaccuucaccaacauggaggugcagcugauccgccagauggaguccgagggcaucuuccucccgagcgagcuggagacccccaaccuggccgagcggguccucgacuggcuggagaagcacggggccgagcgccugaagcggauggccaucuccggcgacgacugcguggugaagcccaucgacgaccgcuucgccacggcgcucaccgcccugaacgacauggggaagguccggaaggacaucccccagugggagccgagcaagggcuggaacgacuggcagcagguccccuucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcgguccccguggacugggugccgaccagccgcaccacguggagcauccacgcccaccaccaguggaugaccaccgaggacaugcucuccgucuggaaccggguguggaucgaggagaaccccuggauggaggacaagacccacgugagcuccugggaggagguccccuaccuggggaagcgcgaggaccaguggugcggcagccugaucggccucacggcccgcgccaccugggccaccaacauccagguggcgaucaaccaggugcggcgccugaucgggaacgagaacuaccuggacuacaugaccuccaugaagcgguucaagaacgagagcgaccccgagggcgcccucugguga

SEQ ID NO: 8074 - RNA, 9879 nt, Artificial Sequence
  derived and/or modified CDS sequence (opt1) from DENV-1__GQ868508__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccaugcccggcaccuucaagacgcccgagggcgaggucggggccaucgcccuggacuucaagcccggcaccagcggguccccgaucgugaaccgggagggcaagaucgugggccuguacgggaacggcgucgugaccaccagcgggacguacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccauggugcgggaggccaucaagcgcaagcugcggacccugauccucgcgcccacgcgcguggucgccuccgagauggccgaggcccugaagggcaugcccauccgcuaccagaccaccgccgucaagagcgagcacaccgggcgggagaucguggaccugaugugccacgcgacguucaccaugcgccuccuguccccgguccgggugcccaacuacaacaugaucaucauggacgaggcccacuucaccgaccccgccagcaucgccgcccgcggcuacaucuccacccggguggggaugggcgaggcggccgccaucuucaugacggccacgccgcccgggagcgucgaggccuucccccaguccaacgcggugauccaggacgaggagcgcgacauccccgagcggagcuggaacuccggcuacgacuggaucaccgacuuccccggcaagaccgugugguucguccccagcaucaaguccgggaacgacaucgccaacugccugcgcaagaacggcaagcgggugauccagcucagccgcaagacguucgacaccgaguaccagaagaccaagaacaacgacugggacuacguggucaccacggacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagacguucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacgcugaugcuccuggcgcugaucgccguccucaccgggggcgugacccuguucuuccugagcgggaagggccucggcaagaccuccaucgggcugcugugcgugacggccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagaccacgaagaaggaccucggcaucgggcacguggcggccgagaaccaccagcacgccaccaugcuggacgucgaccugcggccggccagcgccuggacccucuacgcgguggccaccacggugaucacccccaugaugcgccacaccaucgagaacaccacggccaacaucucccugaccgccaucgccaaccaggcggccauccugaugggccucgacaagggcuggcccaucagcaagauggacaucggggucccccugcuggcccucggcugcuacucccaggugaacccgcugacccugaccgccgcggugcucaugcuggucgcccacuacgccaucaucgggcccggccugcaggccaaggccacgcgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcaccagccagauccugcucaugcgcacgaccugggcgcugugcgaguccaucacccuggccaccgggccgcucacgacccugugggagggcagccccgggaaguucuggaacaccaccaucgccguguccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagaccacgaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccaccuacggcuggaaccuggugaagcugcacagcgggaaggacguguucuucaugccgcccgagaagugcgacacgcuccugugcgacaucggcgaguccagcccgaaccccaccaucgaggaggggcgcacccugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacgcacgagauguacugggugagcugcggcaccgggaacaucgucuccgccgugaacaugaccagccgcaugcuccugaaccgguucaccauggcgcaccgcaagcccacguacgagcgcgacguggaccugggcgccggcacccggcacgucgccguggagcccgagguggccaaccucgacaucaucgggcagcgcaucgagaacaucaagaacgagcacaaguccaccuggcacuacgacgaggacaacccguacaagaccugggccuaccacggcagcuacgaggucaagcccuccgggagcgcguccagcauggugaacggcgugguccggcugcugacgaagcccugggacgugauccccauggucacccagaucgccaugaccgacaccacgccguucgggcagcagcgcguguucaaggagaagguggacacccggacgccccgggccaagcggggcaccacgcagaucauggaggucaccgccaaguggcucuggggcuuccugucccgcaacaagaagccccggaucugcacccgcgaggaguucacccggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgacgugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucaccgaggacgaccuccagaacgaggccaagaucacggagaucauggagcccgagcacgcccugcuggccaccagcaucuucaagcucaccuaccagaacaaggugguccgcgugcagcgccccgcgaagaacggcaccgugauggacgucaucucccggcgcgaccagcgggggagcggccaggugggcacguacgggcugaacaccuucaccaacauggaggugcagcugauccgccagauggaguccgagggcaucuuccuccccagcgagcuggagaccccgaaccuggccgagcggguccucgacuggcuggagaagcacggggccgagcgccugaagcggauggccaucuccggcgacgacugcguggugaagcccaucgacgaccgcuucgccacggcgcucaccgcccugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcgguccccguggacugggugcccaccagccgcaccacguggagcauccacgcccaccaccaguggaugaccaccgaggacaugcucuccgucuggaaccggguguggaucgaggagaacccguggauggaggacaagacccacgugagcuccugggaggagguccccuaccuggggaagcgcgaggaccaguggugcggcagccugaucggccucacggcccgcgccaccugggccaccaacauccagguggcgaucaaccaggugcggcgccugaucgggaacgagaacuaccuggacuacaugaccuccaugaagcgguucaagaacgagagcgaccccgagggcgcccucugguga

SEQ ID NO: 8075 - RNA, 9879 nt, Artificial Sequence
  derived and/or modified CDS sequence (opt1) from DENV-1__GQ868509__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaugagcggcaccaccaccaucuucgccgggcaccugaagugccggcugaagauggacaagcucacgcugaagggcaccuccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcugagcgcggccaucggcaaggccugggaggagggggugugcggcauccgcuccgugacccggcucgagaacaucauguggaagcagaucagcaacgagcugaaccacauccugcucgagaacgacaugaaguucaccgucguggugggggacgccaacggcauccuggcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacaaccagcgggccuggaacaucugggaggucgaggacuacggcuucgggaucuucaccacgaacaucuggcugaagcuccgcgacuccuacacccagaugugcgaccaccggcugaugagcgccgcgaucaaggacuccaaggccgugcacgccgacaugggcuacuggaucgagagcgagaagaacgagaccuggaagcuggcccgcgccuccuucaucgaggugaagaccugcacguggcccaagagccacacccucugguccaacggcguccuggagagcgagaugaucauccccaagaucuacgggggcccgaucucccagcacaacuaccggcccggguacuucacccagaccgcgggccccuggcaccuggggaagcucgagcuggacuucgaccugugcgagggcacgaccgugguggucgacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgccagcaucaugaucgaggaggucaugcggucccgcuggagccggaagaugcucaugaccggcacgcuggccguguuccugcuccugaucauggggcagcugaccuggaacgaccucauccgccugugcaucauggugggcgccaacgcguccgaccgcauggggaugggcaccaccuaccuggcccucauggccacguucaagaugcggccgauguucgccgucgggcugcuguuccgccggcucaccagccgcgaggugcugcugcucaccaucgggcugucccugguggccagcgucgagcuccccaacucccuggaggagcugggcgacgggcucgcgaugggcaucaugaugcugaagcugcucaccgaguuccagccccaccagcuguggacgacccugcucagccugaccuucaucaagaccacgcugucccucgacuacgccuggaagaccaccgccauggcccugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggcgaucggcaucgugagcauccugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggccguguccggcguguaccccaugagcauccccgcgacccuguuccucugguacuucuggcagaagaagaagcagcgguccgggguccugugggacacccccagcccgcccgagguggagcgcgccgugcuggacgacggcaucuaccggauccugcagcgcggccuccuggggcggucccaggucggcguggggguguuccaggacggcgucuuccacaccauguggcacgugacgcgcggggccgugcugauguaccagggcaagcggcucgagcccagcugggccuccgucaagaaggaccugaucagcuacggcgggggcuggcgcuuccagggguccuggaacaccggcgaggagguccaggugaucgccgucgagcccgggaagaacccgaagaacgugcagaccacccccggcacguucaagacccccgagggcgaggugggggcgaucgcccuggacuucaagcccggcaccagcggguccccgaucgucaaccgggagggcaagaucgugggccucuacgggaacggcguggucaccacgagcgggaccuacguguccgccaucgcccaggccaaggcgagccaggagggcccccugcccgagaucgaggacgagguguucaagaagcgcaaccugaccaucauggaccuccacccggggagcggcaagacccggcgcuaccugcccgccaucguccgggaggccaucaagcgcaagcugcggacgcucauccuggcccccacccgcgugguggcguccgagauggccgaggcccugaagggcaugcccauccgcuaccagaccaccgccgucaagagcgagcacacggggcgggagaucguggaccucaugugccacgccaccuucaccaugcgccugcuguccccggugcggguccccaacuacaacaugaucaucauggacgaggcgcacuucaccgaccccgccagcaucgccgcccgcggcuacaucuccacgcggguggggaugggcgaggccgcggccaucuucaugaccgccacgccgcccgggagcguggaggccuucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgcgaacugccuccgcaagaacggcaagcgggucauccagcugagccgcaagaccuucgacaccgaguaccagaagaccaagaacaacgacugggacuacguggugacgaccgacaucuccgagaugggggccaacuuccgggccgaccgcgucaucgacccccggcgcugccugaagcccgugauccucaaggacggccccgagcgggugauccuggccgggccgaugcccgucaccguggcgagcgccgcccagcgccggggccgcaucggccggaaccagaacaaggagggggaccaguacguguacaugggccagccccugaacaacgacgaggaccacgcccacuggaccgaggccaagaugcuccuggacaacaucaacacgcccgaggggaucaucccggcgcuguucgagcccgagcgcgagaaguccgccgccaucgacggcgaguaccgccuccgcggggaggcccgcaagaccuucgucgagcugaugcggcgcggcgaccugcccguguggcucagcuacaaggucgccuccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcgcggaccuacuccgacccgcuggcccugcgcgaguucaaggaguucgccgccgggcggcgcagcgucagcggcgaccucauccuggagaucggcaagcugccccagcaccucacccugcgggcccagaacgcgcuggacaaccucgugaugcugcacaacuccgagcagggcgggaaggccuaccgccacgccauggaggagcugcccgacacgaucgagacccucaugcugcuggcccucaucgcggugcugaccgggggcgucacccuguucuuccucagcgggaagggccugggcaagacguccaucgggcugcucugcgugaccgccagcuccgcccugcuguggauggccagcguggagccccacuggaucgccgcguccaucauccucgaguucuuccugaugguccugcucaucccggagcccgaccggcagcgcacgccccaggacaaccagcuggccuacguggugaucggccuccucuucaugauccugaccgucgccgccaacgagauggggcugcucgagacgaccaagaaggaccugggcaucgggcacguggccgcggagaaccaccagcacgccaccaugcuggacguggaccuccggccggccagcgccuggacccuguacgccgucgcgacgaccgugaucacccccaugaugcgccacaccaucgagaacacgaccgccaacaucucccugaccgccaucgccaaccaggccgcgauccucaugggccuggacaagggcuggcccaucagcaagauggacaucggggugccccugcucgcccugggcugcuacucccaggucaacccgcugacccucacggccgccgugcugaugcugguggcgcacuacgccaucaucgggcccggccuccaggccaaggccacccgggaggcccagaagcgcaccgcggccgggaucaugaagaaccccaccgucgacggcaucguggccaucgaccuggaccccguggucuacgacgccaaguucgagaagcagcugggccagaucaugcuccugauccugugcacgagccagauccuccugaugcgcaccaccugggcccugugcgaguccaucacccucgcgacggggccgcugaccacccugugggagggcagccccgggaaguucuggaacaccacgaucgccguguccauggccaacaucuuccggggcagcuaccucgccggcgccgggcuggcguucucccugaugaagucccucggcgggggccgccgggggaccggcgcccagggcgagacccugggggagaaguggaagcgccagcugaaccagcucuccaagagcgaguucaacaccuacaagcggagcggcaucauggagguggaccgcuccgaggccaaggaggggcugaagcggggcgagacgaccaagcacgccgucagccgcgggaccgcgaagcugcggugguucguggagcgcaaccuggugaagcccgagggcaaggucaucgaccucggcugcgggcggggcgggugguccuacuacugcgccggccugaagaaggugaccgaggugaagggguacaccaagggcggccccgggcacgaggagccgauccccauggccacguacggcuggaaccuggucaagcuccacagcgggaaggacguguucuucaugccgcccgagaagugcgacacccugcugugcgacaucggcgaguccagcccgaaccccaccaucgaggaggggcgcacccuccgggugcugaagauggucgagcccuggcugcgcggcaaccaguucugcaucaagauccucaaccccuacaugccguccgugguggagacgcuggagcagaugcagcggaagcacggcgggaugcugguccgcaacccccucagccggaacuccacccacgagauguacugggugagcugcggcaccgggaacaucguguccgccgucaacaugaccagccgcaugcugcugaaccgguucacgauggcccaccgcaagcccaccuucgagcgcgacguggaccucggcgcgggcacccggcacguggccgucgagcccgagguggccaaccuggacaucaucgggcagcgcaucgagaacaucaagaacgagcacaaguccaccuggcacuacgacgaggacaacccguacaagacgugggccuaccacggcagcuacgaggugaagcccuccgggagcgccuccagcauggucaacggcguggugcggcugcucaccaagcccugggacgucauccccauggugacccagaucgcgaugaccgacacgaccccguucgggcagcagcgcgucuucaaggagaagguggacacccggacgccccgggccaagcggggcacgacccagaucauggaggugaccgccaaguggcuguggggcuuccugucccgcaacaagaagccccggaucugcacccgcgaggaguucacgcggaagguccgcagcaacgccgccaucggggcgguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgccgacgacaccgcggggugggacacccggaucacggaggacgaccugcagaacgaggccaagaucaccgacaucauggagcccgagcacgcccugcucgccaccagcaucuucaagcugaccuaccagaacaagguggugcgcguccagcgccccgccaagaacggcacggugauggacgugaucucccggcgcgaccagcgggggagcggccaggucggcaccuacgggcugaacaccuucaccaacauggaggugcagcucauccgccagauggaguccgagggcaucuuccugcccagcgagcuggagacgccgaaccucgcggagcgggugcuggacuggcuggagaagcacggggccgagcgccucaagcggauggccaucuccggcgacgacugcgucgugaagcccaucgacgaccgcuucgccaccgcccugaccgcgcugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagaccgccugccucggcaagagcuacgcccagauguggcagcugauguacuuccaccggcgcgaccugcggcucgcggccaacgccaucugcuccgccgugcccgucgacugggugcccaccagccgcacgaccuggagcauccacgcgcaccaccaguggaugaccaccgaggacaugcuguccguguggaaccgggucuggaucgaggagaacccguggauggaggacaagacgcacgugagcuccugggaggaggugcccuaccuggggaagcgcgaggaccaguggugcggcagccucaucggccugaccgcccgcgccaccugggccaccaacauccaggucgccaucaaccaggugcggcgccugaucgggaacgagaacuaccucgacuacaugacguccaugaagcgguucaagaacgagagcgaccccgagggcgcgcugugguga

SEQ ID NO: 8076 - RNA, 9879 nt, Artificial Sequence
  derived and/or modified CDS sequence (opt1) from DENV-1__GQ868510__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcggccaccgccgggagaagcgcuccguggcccuggcgccccacguggggcugggccucgagacgcggaccgagaccuggaugagcuccgagggggccuggaagcagauccagcgggucgagaccugggcccugcggcaccccggcuucacggugaucgcccuguuccucgcgcacgccaucgggaccagcaucacccagaagggcaucaucuucauccugcugaugcucgugacccccuccauggccaugcgcugcgucggcaucgggaaccgggacuucguggagggccugagcggggccacguggguggacgucgugcuggagcacggcuccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggguggggcaacgggugcggccucuucgggaagggcagccugcugacgugcgccaaguucaagugcgugaccaagcucgagggcaagaucgugcaguacgagaaccugaaguacuccgucaucgugaccgugcacaccggggaccagcaccaggucggcaacgagacgaccgagcacgggaccaucgcgaccaucacgccccaggcccccacgagcgagauccagcugaccgacuacggcgcccucacccuggacugcagcccccggaccgggcuggacuucaacgagauggugcuccugacgaugaaggagaaguccuggcugguccacaagcagugguuccucgaccugccgcugcccuggaccuccggcgccagcaccagccaggagaccuggaaccgccaggaccuccuggugacguucaagaccgcccacgcgaagaagcaggagguggucgugcugggcucccaggagggggccaugcacaccgcccucaccggcgccacggagauccagaccagcgggaccaccacgaucuucgccggccaccugaagugccggcugaagauggacaagcucacccugaaggggaccuccuacgugaugugcaccggcagcuucaagcuggagaaggaggucgcggagacgcagcacggcaccgugcuggugcaggucaaguacgaggggaccgacgcccccugcaagauccccuucuccacccaggacgagaagggcgugacgcagaacgggcgccucaucaccgccaacccgaucgugaccgacaaggagaagcccgucaacaucgagaccgagccgcccuucggcgagagcuacaucguggugggcgccggggagaaggcgcugaagcuguccugguucaagaagggcagcuccaucgggaagauguucgaggccacggcccggggcgcccgccggauggccauccucggggacaccgcgugggacuucggcagcaucggcggggucuucaccuccgugggcaagcuggugcaccaggucuucgggaccgccuacggcgugcuguucagcgggguguccuggacgaugaagaucggcaucggcauccuccugaccuggcuggggcucaacagccgcuccaccagccuguccaugaccugcaucgccgucggcauggugacgcuguaccucggggugaugguccaggccgacagcggcugcgugaucaacuggaaggggcgcgagcugaagugcggcuccggcaucuucgugaccaacgagguccacaccuggaccgagcaguacaaguuccaggccgacagcccgaagcggcugagcgcggccaucgggaaggccugggaggagggcgugugcgggauccgcuccgccacccggcucgagaacaucauguggaagcagaucagcaacgagcugaaccacauccugcucgagaacgacaugaaguucacgguggucgugggcgacgccaacgggauccuggcgcagggcaagaagaugauccgcccccagcccauggagcacaaguacuccuggaaguccuggggcaaggccaagaucaucggggccgacauccagaacaccaccuucaucaucgacggccccgacaccccggagugccccgacauccagcgggccuggaacaucugggagguggaggacuacggguucggcaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggggugcuggagagcgagaugaucauccccaagaucuacggcgggccgaucucccagcacaacuaccggcccggcuacuucacccagacggccgggcccuggcaccugggcaagcucgagcuggacuucgaccugugcgagggcaccaccgucgugguggacgagcacugcgggaaccgcggcccgagccuccggaccacgaccgucaccgggaagaucauccacgaguggugcugccgcuccugcacccugccgccccugcgguuccgcggcgaggacgggugcugguacggcauggagauccggcccgugaaggagaaggaggagaaccucgugcgcagcauggucuccgccggcagcggggagguggacagcuucucccugggcauccugugcgccagcaucaugaucgaggaggugaugcggucccgcuggagccggaagaugcucaugacggggacccuggccgucuuccugcuccugaucaugggccagcugaccuggaaggaccucauccgccugugcaucauggugggggcgaacgccuccgaccgcaugggcaugggcaccacguaccuggcccucauggccaccuucaagaugcggccgauguucgccguggggcugcuguuccgccggcucaccagccgcgagguccugcugcucaccaucggccugucccugguggcgagcguggagcuccccaacucccuggaggagcugggggacggccucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccuggggagccugggcugcaagccccucaccauguuccugaucacggagaacaagaucugggggcggaaguccuggccccugaacgagggcaucauggccaucgggaucgucagcauccuccuguccagccugcucaagaacgacgugccccuggccggcccgcugaucgccggcgggaugcucaucgccugcuacgugaucagcggcuccagcgcggaccugucccuggagaaggccgccgaggucagcugggagcaggaggccgagcacuccgggaccagccacaacauccucguggaggugcaggacgacggcaccaugaagaucaaggacgaggagcgcgacgacacccugacgauccugcucaaggccacccugcuggcggucuccgggguguaccccaugagcauccccgccacccucuucgugugguacuucuggcagaagaagaagcagcgguccggcguccugugggacacccccagcccgcccgagguggagcgcgccgugcuggacgacggcaucuaccggauccugcagcgcgggcuccugggccggucccaggucggggugggcguguuccaggacggggucuuccacacgauguggcacgugacccgcggcgccgugcugauguaccagggcaagcggcucgagcccagcugggccuccgucaagaaggaccugaucagcuacgggggcggguggcgcuuccagggcuccuggaacaccggggaggagguccaggugaucgcggucgagcccggcaagaacccgaagaacgugcagaccacgcccggcaccuucaagacccccgagggggaggugggcgccaucgcccuggacuucaagcccgggaccagcggcuccccgaucgucaaccgggagggcaagaucguggggcucuacggcaacgggguggucacgaccagcggcaccuacguguccgccaucgcccaggcgaaggccagccaggaggggccccugcccgagaucgaggacgagguguucaagaagcgcaaccugaccaucauggaccuccacccgggcagcggcaagacgcggcgcuaccugcccgccaucguccgggaggccaucaagcgcaagcugcggacccucauccuggcgcccacccgcgugguggccuccgagauggccgaggcccugaaggggaugcccauccgcuaccagaccacggccgucaagagcgagcacaccggccgggagaucguggaccucaugugccacgcgaccuucaccaugcgccugcuguccccggugcggguccccaacuacaacaugaucaucauggacgaggcccacuucacggaccccgccagcaucgccgcccgcggguacaucuccacccgggugggcaugggggaggcggccgccaucuucaugaccgccacgccgcccggcagcguggaggccuucccccaguccaacgcggucauccaggacgaggagcgcgacauccccgagcggagcuggaacuccggcuacgacuggaucacggacuuccccgggaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccccggcgcugccugaagcccgugauccucaaggacgggcccgagcgggugauccuggcgggcccgaugcccgucaccguggccagcgccgcccagcgccggggccgcaucgggcggaaccagaacaaggagggcgaccaguacguguacauggggcagccccugaacaacgacgaggaccacgcccacuggacggaggcgaagaugcuccuggacaacaucaacacccccgagggcaucaucccggcccuguucgagcccgagcgcgagaaguccgccgccaucgacggggaguaccgccuccggggcgaggcccgcaagaccuucgucgagcugaugcggcgcggcgaccugcccguguggcucagcuacaaggucgcguccgagggguuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacuccgacccgcuggcccugcgcgaguucaaggaguucgccgccggccggcgcagcgucagcggcgaccucauccuggagaucgggaagcugccccagcaccucacgcugcgggcgcagaacgcccuggacaaccucgugaugcugcacaacuccgagcagggcgggaaggccuaccgccacgccauggaggagcugcccgacaccaucgagacccucaugcugcuggcgcucaucgccgugcugaccggcggggucacgcuguucuuccucagcggcaagggccuggggaagaccuccaucggccugcucugcgugaccgccagcuccgcccugcuguggauggccagcguggagccccacuggaucgcggccuccaucauccucgaguucuuccugaugguccugcucaucccggagcccgaccggcagcgcacgccccaggacaaccagcuggccuacguggugaucgggcuccuguucaugauccugacggucgccgccaacgagaugggccugcucgagaccaccaagaaggaccuggggaucggccacguggcggccgagaaccaccagcacgccaccaugcuggacguggaccuccggccggccagcgccuggacgcuguacgcggucgccaccaccgugaucacccccaugaugcgccacacgaucgagaacaccaccgccaacaucucccugaccgccaucgccaaccaggcggccauccucaugggccuggacaagggguggcccaucagcaagauggacaucggcgugccccugcucgcccuggggugcuacucccaggucaacccgcugacgcucaccgccgcggugcugaugcugguggcccacuacgccaucaucggccccgggcuccaggccaaggccacccgggaggcgcagaagcgcaccgccgccggcaucaugaagaaccccacggucgacggcaucguggccaucgaccuggaccccguggucuacgacgccaaguucgagaagcagcuggggcagaucaugcuccugauccugugcaccagccagauccuccugaugcgcaccaccugggcgcugugcgaguccaucacgcucgccaccggcccgcugaccacccugugggaggggagccccggcaaguucuggaacacgaccaucgccguguccauggccaacaucuuccggggcagcuaccucgccggggcgggccuggccuucucccugaugaagucccucgggggcgggcgccggggcaccggcgcccagggggagacccugggcgagaaguggaagcgccagcugaaccagcucuccaagagcgaguucaacacguacaagcggagcgggaucauggagguggaccgcuccgaggccaaggagggccugaagcgcggggagaccaccaagcacgcggucagccgcggcaccgccaagcugcggugguucguggagcgcaaccuggugaagcccgagggcaaggucaucgaccucgggugcggccgcgggggcugguccuacuacugcgccgggcugaagaaggugaccgaggugaagggcuacacgaagggcgggcccggccacgaggagccgauccccauggccaccuacggguggaaccuggucaagcuccacagcggcaaggacguguucuucaugccgcccgagaagugcgacacccugcugugcgacaucggggaguccagcccgaaccccaccaucgaggagggccgcacgcuccgggugcugaagauggucgagcccuggcugcgcggcaaccaguucugcaucaagauccucaaccccuacaugccguccgugguggagacccuggagcagaugcagcggaagcacgggggcaugcugguccgcaacccccucagccggaacuccacccacgagauguacugggugagcugcgggaccggcaacaucguguccgccgucaacaugacgagccgcaugcugcugaaccgguucaccauggcgcaccgcaagcccaccuacgagcgcgacguggaccucggcgccgggacccggcacguggccgucgagcccgagguggccaaccuggacaucaucggccagcgcaucgagaacaucaagaacgagcacaaguccacguggcacuacgacgaggacaacccguacaagaccugggccuaccacgggagcuacgaggugaagcccuccggcagcgcguccagcauggucaacgggguggugcggcugcucaccaagcccugggacgucauccccauggugacccagaucgccaugacggacaccaccccguucggccagcagcgcgucuucaaggagaagguggacacccggacgccccgcgccaagcggggcaccacccagaucauggaggugaccgccaaguggcuguggggguuccugucccgcaacaagaagccccggaucugcacgcgcgaggaguucacccggaagguccgcagcaacgccgcgaucggcgccguguucguggacgagaaccaguggaacagcgccaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaagggcucccgggccaucugguacauguggcucggggcccgcuuccuggaguucgaggcccugggcuucaugaacgaggaccacugguucagccgggagaacucccucagcggggucgagggcgaggggcugcacaagcugggcuacauccuccgcgacaucuccaagaucccgggcgggaacauguacgcggacgacaccgccggcugggacacgcggaucaccgaggacgaccugcagaacgaggccaagaucaccgacaucauggagcccgagcacgcccugcucgccaccagcaucuucaagcugacguaccagaacaagguggugcgcguccagcgccccgcgaagaacgggaccgugauggacgugaucucccggcgcgaccagcggggcagcggccaggucgggaccuacggccugaacaccuucacgaacauggaggugcagcucauccgccagauggaguccgaggggaucuuccugcccagcgagcuggagaccccgaaccucgccgagcgggugcuggacuggcugggcaagcacggggccgagcgccucaagcggauggccaucuccggcgacgacugcgucgugaagcccaucgacgaccgcuucgccaccgcgcugaccgcccugaacgacaugggcaaggugcggaaggacaucccccagugggagcccagcaagggguggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagaccgccugccucggcaagagcuacgcgcagauguggcagcugauguacuuccaccggcgcgaccugcggcucgccgccaacgccaucugcuccgcggugcccgucgacugggugcccacgagccgcaccaccuggagcauccacgcccaccaccaguggaugaccacggaggacaugcuguccguguggaaccgggucuggaucgaggagaacccguggauggaggacaagacccacgugagcuccugggaggaggugcccuaccugggcaagcgcgaggaccaguggugcgggagccucaucggccugaccgcccgcgccaccugggccacgaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8077 - RNA, 9879 nt, Artificial Sequence
  derived and/or modified CDS sequence (opt1) from DENV-1__GQ868511__SS-prME
agcgugaccaugcugcucaugcugcugcccaccgcccucgccuuccaccugacgacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaccugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccuggugauggggcagcugaccuggaacgaccucauccgccugugcaucauggugggcgcgaacgccuccgaccgcauggggaugggcacgaccuaccuggcccucauggccaccuucaagaugcggccgauguucgccgucggccugcuguuccgccggcucaccagccgcgaggugcugcugcucacgaucgggcugucccugguggcgagcgucgagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgugucccuguucccccucugccugagcaccaccucccagaagaccaccuggcugccgguccuccugggcagcuucgggugcaagccccugacgauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacgcucaccauccugcugaaggccacccuccuggcgguguccggcguguaccccaugagcauccccgccacccuguucgucugguacuucuggcagaagaagaagcagcgguccggggugcucugggacacgcccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagacgacccccggcaccuucaagacccccgagggcgaggucggggccaucgcccuggacuucaagcccggcacgagcggguccccgaucgugaaccgggagggcaagaucgugggccuguacgggaacggcgucgugaccaccagcgggaccuacguguccgccaucgcccaggcgaaggccagccaggagggcccccuccccgagaucgaggacgaggucuucaagaagcgcaaccugacgaucauggaccugcacccggggagcggcaagacccggcgcuaccuccccgccaucgugcgggaggccaucaagaagaagcugcgcacccugauccucgcgcccacccggguggucgccuccgagauggccgaggcccugaagggcaugcccauccgcuaccagacgaccgccgucaagagcgagcacaccgggcgcgagaucguggaccugaugugccacgcgaccuucacgaugcggcuccuguccccgguccgcgugcccaacuacaacaugaucaucauggacgaggcccacuucaccgaccccgccagcaucgccgcccggggcuacaucuccacccgcguggggaugggcgaggcggccgccaucuucaugaccgccacgcccccggggagcgucgaggccuucccccaguccaacgcggugauccaggacgaggagcgggacauccccgagcgcagcuggaacuccggcuacgacuggaucaccgacuuccccggcaagaccgugugguucgucccgagcaucaaguccgggaacgacaucgccaacugccugcggaagaacggcaagcgcgugauccagcucagccggaagaccuucgacacggaguaccagaagaccaagaacaacgacugggacuacguggucaccaccgacaucuccgagaugggggccaacuuccgcgccgaccgggugaucgacccccgccggugccugaagcccgugauccugaaggacggccccgagcgcgucauccucgcggggccgaugcccgugacgguggccagcgccgcccagcggcgcggccggaucggccgcaaccagaacaaggagggggaccaguacgucuacaugggccagccccugaacaacgacgaggaccacgcccacuggaccgaggcgaagaugcugcucgacaacaucaacacccccgaggggaucaucccggcccuguucgagcccgagcgggagaaguccgccgccaucgacggcgaguaccgccugcgcggggaggcccggaagaccuucguggagcucaugcgccggggcgaccugcccgucuggcugagcuacaagguggcguccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcacguacuccgacccgcucgcccugcgggaguucaaggaguucgccgccgggcgccggagcgugagcggcgaccugauccucgagaucggcaagcugccccagcaccugacccuccgcgcgcagaacgcccuggacaaccuggugaugcuccacaacuccgagcagggcgggaaggccuaccggcacgccauggaggagcugcccgacaccaucgagacccugaugcuccuggcgcugaucgccguccucaccggcggggugacccuguucuuccugagcgggaaggggcucggcaagaccuccaucgggcugcugugcgugaccgccagcuccgcccuccuguggauggccagcgucgagccccacuggaucgcggccuccaucauccuggaguucuuccucauggugcugcugaucccggagcccgaccgccagcggacgccccaggacaaccagcucgccuacguggucaucggccugcuguucaugauccucaccguggccgccaacgagauggggcugcuggagaccaccaagaaggaccucggcaucgggcacguggcggccgagaaccaccagcacgccacgaugcuggacgucgaccugcgcccggccagcgccuggacccucuacgcgguggccaccaccgugaucacgcccaugaugcggcacaccaucgagaacaccaccgccaacaucucccugacggccaucgccaaccaggcggccauccugaugggccucgacaagggcuggcccaucagcaagauggacaucggggucccccugcuggcccucggcugcuacucccaggugaacccgcugacccugaccgccgcggugcucaugcuggucgcccacuacgccaucaucgggcccggccugcaggccaaggccacccgcgaggcgcagaagcggacggccgccgggaucaugaagaaccccaccguggacggcaucguggccaucgaccucgaccccgucguguacgacgccaaguucgagaagcagcugggccagaucaugcugcucauccugugcaccagccagauccugcucaugcgcaccacgugggcgcugugcgaguccaucacccuggccaccgggccgcucaccacgcugugggagggcagccccgggaaguucuggaacaccaccaucgccguguccauggccaacaucuuccgcggcagcuaccuggccggcgcggggcucgccuucucccugaugaagucccugggcgggggccggcgcgggaccggcgcccagggcgagacgcucggggagaaguggaagcggcagcugaaccagcuguccaagagcgaguucaacgccuacaagcgcagcggcaucauggaggucgaccgguccgaggcgaaggaggggcucaagcgcggcgagaccaccaagcacgccgugagccgggggaccgccaagcugcgcugguucguggagcggaaccuggucaagcccgagggcaaggugaucgaccugggcugcgggcgcggcgggugguccuacuacugcgccggccucaagaaggugaccgaggucaagggguacacgaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccaccaucgaggaggggcggacgcugcgcguccucaagaugguggagcccuggcugcggggcaaccaguucugcaucaagauccugaaccccuacaugccguccguggucgagacccucgagcagaugcagcgcaagcacggcgggaugcuggugcggaacccccugagccgcaacuccacccacgagauguacugggugagcugcggcaccgggaacaucgucuccgcggugaacaugacgagccggaugcuccugaaccgcuucaccauggcccaccggaagcccaccuacgagcgcgacguggaccugggcgccggcacccgccacgucgccguggagcccgagguggccaaccucgacaucaucgggcagcggaucgagaacaucaagaacgagcacaaguccacguggcacuacgacgaggacaacccguacaagaccugggcguaccacggcagcuacgaggucaagcccuccgggagcgccuccagcauggugaacggcgugguccgccugcugaccaagcccugggacgugauccccauggucacccagaucgccaugacggacaccaccccguucgggcagcagcggguguucaaggagaagguggacacccgcacgccccgggccaagcgcggcaccacccagaucauggaggucaccgccaaguggcucuggggcuuccugucccggaacaagaagccccgcaucugcacgcgggaggaguucacccgcaaggugcggagcaacgcggccaucggggccguguucgucgacgagaaccaguggaacagcgccaaggaggcgguggaggacgaguccuucugggaccuggugcacaaggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagaucccgggcggcaacauguacgccgacgacaccgccgggugggacacgcgcaucaccgaggacgaccuccagaacgaggccaagaucaccgagaucauggagcccgagcacgcccugcuggcgaccuccaucuucaagcucacguaccagaacaaggugguccgggugcagcgccccgccaagaacggcaccgugauggacgucaucagccggcgcgaccagcgcggguccggccaggugggcaccuacgggcugaacaccuucacgaacaugggcgugcagcugauccggcagauggagagcgaggggaucuuccuccccuccgagcuggagaccccgaaccuggccgagcgcguccucgacuggcuggagaagcacggcgccgagcggcugaagcgcauggccaucagcggggacgacugcguggugaagcccaucgacgaccgguucgcgaccgcccucaccgcccugaacgacaugggcaagguccgcaaggacaucccccagugggagcccuccaagggcuggaacgacuggcagcaggucccguucugcagccaccacuuccaccagcugaucaugaaggacgggcgggagaucgugguccccugccgcaaccaggacgagcucgugggccgggcccgcgugucccagggggccggcuggagccugcgggagaccgcgugccuggggaaguccuacgcccagauguggcagcucauguacuuccaccgccgggaccugcgccuggccgccaacgcgaucugcagcgccguccccguggacugggugcccacgagccggaccaccugguccauccacgcccaccaccaguggaugaccacggaggacaugcucagcgucuggaaccgcguguggaucgaggagaacccguggauggaggacaagacccacguguccagcugggaggagguccccuaccugggcaagcgggaggaccaguggugcggcucccugaucgggcucaccgcccgcgccaccugggcgacgaacauccagguggccaucaaccaggugcggcgccugaucggcaacgagaacuaccuggacuacaugaccagcaugaagcgcuucaagaacgaguccgaccccgagggggcccucugguga

SEQ ID NO: 8078 - RNA, 9879 nt, Artificial Sequence
  derived and/or modified CDS sequence (opt1) from DENV-1__GQ868512__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggaggcccucgagcagaugcagcggaagcacggcgggaugcuggugcgcaacccccugagccggaacuccacccacgagauguacugggucagcugcggcaccgggaacaucguguccgccgugaacaugaccagccgcaugcuccugaaccgguucacgauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccaccuggcacuacgacgaggacaacccguacaagacgugggccuaccacggcagcuacgaggugaagcccuccgggagcgcguccagcauggugaacggcgucgugcggcugcugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggucgugcgcgugcagcgccccgcgaagaacggcacggucauggacgugaucucccggcgcgaccagcgggggagcggccaggugggcaccuacgggcugaacaccuucaccaacauggagguccagcugauccgccagauggaguccgagggcaucuuccuccccagcgagcuggagacgccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccaccagccgcacgaccuggagcauccacgcccaccaccaguggaugaccaccgaggacaugcucuccguguggaaccggguguggaucgaggagaacccguggauggaggacaagacgcacgucagcuccugggaggaggugcccuaccuggggaagcgcgaggaccaguggugcggcagccugaucggccucaccgcccgcgccaccugggccaccaacauccagguggcgaucaaccagguccggcgccugaucgggaacgagaacuaccuggacuacaugacguccaugaagcgguucaagaacgagagcgaccccgagggcgcccucugguga

SEQ ID NO: 8079 - RNA, 9879 nt, Artificial Sequence
  derived and/or modified CDS sequence (opt1) from DENV-1__GU131970__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccgccgggagaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaccauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugaccggcacccuggccguguuccugcuccugaucauggggcagcugaccuggaaggaccucauccgccugugcaucauggugggcgccaacgcguccgaccgcauggggaugggcacgaccuaccuggcccucauggccaccuucaagaugcggccgauguucgccgucggccugcuguuccgccggcucaccagccgcgaggugcugcugcucacgaucgggcugucccugguggccagcgucgagcuccccaacucccuggaggagcugggcgacgggcucgcgaugggcaucaugaugcugaagcugcucaccgaguuccacccccaccagcuguggaccacccugcucagccugacguucaucaagaccacccugucccucgacuacgccuggaagaccacggccauggcccugagcaucgugucccuguucccccucugccugagcaccaccucccagaagaccaccuggcugccgguccuccugggcagcuucgggugcaagccccugacgauguuccucaucaccgagaacaagaucuggggccggaaguccuggccccugaacgaggggaucauggcgaucggcaucgugagcauccugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcaccagccacaacauccugguggagguccaggacgacgggaccaugaagaucaaggacgaggagcgcgacgacacgcucaccauccugcugaaggccacccuccuggccguguccggcguguaccccaugagcauccccgcgacccuguucgucugguacuucuggcagaagaagaagcagcgguccggggugcucugggacacgcccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagacgacccccggcaccuucaagacccccgagggcgaggucggggcgaucgcccuggacuucaagcccggcacgagcggguccccgaucgugaaccgggagggcaagaucgugggccuguacgggaacggcgucgugaccaccagcgggaccuacguguccgccaucgcccaggccaaggcgagccaggagggcccccuccccgagaucgaggacgaggucuucaagaagcgcaaccugacgaucauggaccugcacccggggagcggcaagacccggcgcuaccuccccgccaucgugcgggaggccaucaagcgcaagcugcggacccugauccucgcccccacccgcguggucgcguccgagauggccgaggcccugaagggcaugcccauccgcuaccagacgaccgccgucaagagcgagcacaccgggcgggagaucguggaccugaugugccacgccaccuucacgaugcgccuccuguccccgguccgggugcccaacuacaacaugaucaucauggacgaggcgcacuucaccgaccccgccagcaucgccgcccgcggcuacaucuccacccggguggggaugggcgaggccgcggccaucuucaugaccgccacgcccccggggagcgucgaggccuucccccaguccaacgccgugauccaggacgaggagcgcgacauccccgagcggagcuggaacuccggcuacgacuggaucaccgacuuccccggcaagaccgugugguucgucccgagcaucaaguccgggaacgacaucgcgaacugccugcgcaagaacggcaagcgggugauccagcucagccgcaagaccuucgacacggaguaccagaagaccaagaacaacgacugggacuacguggucaccaccgacaucuccgagaugggggccaacuuccgggccgaccgcgugaucgacccccggcgcugccugaagcccgugauccugaaggacggccccgagcgggucauccucgccgggccgaugcccgugacgguggcgagcgccgcccagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcgcggacguacuccgacccgcucgcccugcgcgaguucaaggaguucgccgccgggcggcgcagcgugagcggcgaccugauccucgagaucggcaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcgguccucaccggcggggugacccuguucuuccugagcgggaaggggcucggcaagaccuccaucgggcugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagaccaccaagaaggaccucggcaucgggcacguggccgcggagaaccaccagcacgccacgaugcuggacgucgaccugcggccggccagcgccuggacccucuacgccguggcgaccaccgugaucacgcccaugaugcgccacaccaucgagaacaccaccgccaacaucucccugacggccaucgccaaccaggccgcgauccugaugggccucgacaagggcuggcccaucagcaagauggacaucggggucccccugcuggcccucggcugcuacucccaggugaacccgcugacccugaccgccgccgugcucaugcuggucgcgcacuacgccaucaucgggcccggccugcaggccaaggccacccgggaggcccagaagcgcacggcggccgggaucaugaagaaccccaccguggacggcaucguggccaucgaccucgaccccgucguguacgacgccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggaggucgaccgcuccgaggccaaggaggggcucaagcggggcgagaccaccaagcacgccgugagccgcgggaccgcgaagcugcggugguucguggagcgcaaccuggucaagcccgagggcaaggugaucgaccugggcugcgggcggggcgggugguccuacuacugcgccggccucaagaaggugacggaggucaagggguacaccaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccacgaucgaggaggggcgcacccugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacccacgagauguacugggugagcugcggcacggggaacaucgucuccgccgugaacaugaccagccgcaugcuccugaaccgguucaccauggcccaccgcaagcccaccuacgagcgcgacguggaccugggcgcgggcacgcggcacgucgccguggagcccgagguggccaaccucgacaucaucgggcagcgcaucgagaacaucaagaacgagcacaaguccaccuggcacuacgacgaggacaacccguacaagaccugggccuaccacggcagcuacgaggucaagcccuccgggagcgccuccagcauggugaacggcgugguccggcugcugaccaagcccugggacgugauccccauggucacgcagaucgcgaugaccgacaccaccccguucgggcagcagcgcguguucaaggagaagguggacacgcggacgccccgggccaagcggggcaccacccagaucauggaggucacggccaaguggcucuggggcuuccugucccgcaacaagaagccccggaucugcacccgcgaggaguucacccggaaggugcgcagcaacgccgccaucggggcgguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacacggcggggugggacacccggaucaccgaggacgaccuccagaacgaggccaagaucaccgacaucauggagcccgagcacgcccugcuggccacgagcaucuucaagcucaccuaccagaacaaggugguccgcgugcagcgccccgccaagaacggcaccgugauggacgucaucucccggcgcgaccagcgggggagcggccaggugggcaccuacgggcugaacacguucaccaacauggaggugcagcugauccgccagauggaguccgagggcaucuuccuccccagcgagcuggagaccccgaaccuggcggagcggguccucgacuggcuggagaagcacggggccgagcgccugaagcggauggccaucuccggcgacgacugcguggugaagcccaucgacgaccgcuucgccaccgcccucaccgcgcugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugaaggagacggccugccugggcaagagcuacgcccagauguggcagcucauguacuuccaccgccgggaccugcgccuggcggccaacgccaucugcuccgccguccccguggacugggugcccaccagccggaccaccuggagcauccacgcgcaccaccaguggaugacgaccgaggacaugcucuccgucuggaaccgcguguggaucgaggagaacccguggauggaggacaagacccacgugagcuccugggaggagguccccuaccuggggaagcgggaggaccaguggugcggcagccugaucggccucaccgcccgcgccacgugggccaccaacauccagguggccaucaaccaggugcgccggcugaucgggaacgagaacuaccuggacuacaugaccuccaugaagcgcuucaagaacgagagcgaccccgagggcgcgcucugguga

SEQ ID NO: 8080 - RNA, 9879 nt, Artificial Sequence
  derived and/or modified CDS sequence (opt1) from DENV-1__KF955427__SS-prME
agcgugaccaugcugcucaugcugcugcccaccgcgcucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcagcgagggcgccuggaagcagauccagcggguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccccugcccuggaccuccggggccagcaccagccaggagaccuggaaccgccaggaccuccuggugacguucaagaccgcccacgcgaagaagcaggagguggucgugcugggcucccaggagggcgccaugcacaccgccuggaccggggccacggagauccagaccagcggcaccaccacgaucuucgccgggcaccucaaguggcggcugaagauggacaagcugacccucaagggcaccuccuacgugaugugcaccgggagcuucaagcuggagaaggaggucgcggagacgcagcacggcaccggccugguccaggugaaguacgaggggaccgacgcccccugcaagauccccuucuccgcccaggacgagaagggcgucacccagaacgggcgccugaucacggccaacccgaucgugaccgacaaggagaagcccgugaacaucgagaccgagccgcccuucggcgagagcuacaucgucgugggcgcgggggagaaggcccucaagcuguccugguucaagaagggcagcuccaucgggaagauguucgaggccaccgcccggggcgcccgccggauggcgauccugggggacacggccugggacuucggcagcaucggcgggguguucaccuccgucggcaagcucgugcaccagguguucgggaccgccuacggcguccuguucagcgggguguccuggaccaugaagaucggcaucggcauccugcucacguggcuggggcugaacagccgcuccaccagccucuccaugaccugcaucgccgugggcauggucacccuguaccugggggugauggugcaggccgacagcggcugcgucaucaacuggaaggggcgcgagcucaagugcggcuccggcaucuucgugacgaacgaggugcacaccuggaccgagcaguacaaguuccaggcggacagcccgaagcggcugagcgccgccaucgggaaggccugggaggagggcgucugcgggauccgcuccgccacccggcuggagaacaucauguggaagcagaucagcaacgagcucaaccacauccugcuggagaacgacaugaaguucaccgugguggucggcgacgcgaacgggauccucgcccagggcaagaagaugauccgcccccagcccauggagcacaaguacuccuggaaguccuggggcaaggccaagaucaucggggccgacauccagaacacgaccuucaucaucgacggccccgacaccccggagugccccgacaaccagcgggcguggaacaucugggagguggaggacuacggguucggcaucuucaccacgaacaucuggcugaagcugcgcgacuccuacacccagaugugcgaccaccggcucaugagcgccgccaucaaggacuccaaggccgugcacgccgacaugggcuacuggaucgagagcgagaagaacgagaccuggaagcuggcgcgcgccuccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgccagcaucaugaucgaggaggugaugcggucccgcuggagccggaagaugcugaugaccgggacgcucgcgguguuccugcugcucgucaugggccagcugaccuggaacgaccugauccgccucugcaucauggugggggccaacgccuccgaccgcaugggcaugggcaccaccuaccuggcccugauggccacguucaagaugcggccgauguucgcgguggggcuccuguuccgccggcugaccagccgcgagguccuccugcugaccaucggccucucccugguggccagcguggagcugcccaacucccucgaggagcugggggacggccuggccaugggcaucaugaugcucaagcugcugaccgaguuccagccccaccagcucuggacgacccugcugagccucaccuucaucaagaccacgcugucccuggacuacgccuggaagaccaccgcgauggcccucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccugccggacccccucaucgccggcggcauccugaucgccugcuacgugaucagcggguccagcgcggaccugucccucgagaaggccgccgagaugagcugggagcaggaggccgagcacuccggcacgagccacaacauccuggucgaggugcaggacgacgggcccaugaagaucaaggacgaggagcgcgacgacacccugaccauccuccugaaggccacccugcucgcgguguccggcgucuaccccaugagcaucccggggacgcuguucgugugguacuucuggcagaagaagaagcagcgguccggcgugcugugggacacccccuccccgcccaaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagccgagcugggccuccgugaagaaggaccugaucagcuacgggggcggguggcgcuuccagggcuccuggaacacgggggaggagguccaggugaucgccguggagcccggcaagaaccccaagaacguccagaccacccccggcaccuucaagacgccggagggggaggugggcgcgaucgcccucgacuucaagcccgggaccagcggcucccccaucgugaaccgggagggcaagaucgucgggcuguacggcaacgggguggugaccaccagcggcacguacgucuccgccaucgcccaggccaaggcgagccaggaggggccgcugcccgagaucgaggacgagguguucaagaagcgcaaccucaccaucauggaccugcaccccggcagcggcaagacccggcgcuaccugcccgccaucgugcgggaggccaucaagcgcaagcuccggacccugauccuggccccgacgcgcgucguggcguccgagauggccgaggcccucaaggggaugcccauccgcuaccagaccaccgccgucaagagcgagcacaccggccgggagaucgucgaccugaugugccacgccacguucaccaugcgccugcucucccccgugcgggugcccaacuacaacaugaucaucauggacgaggcgcacuucaccgacccggccagcaucgccgcccgcggguacaucuccacccgggucggcaugggggaggccgcggccaucuucaugacggccacgccgcccggcagcguggaggccuucccccaguccaacgccgugauccaggacgaggagcgcgacaucccggagcggagcuggaacuccggcuacgacuggaucaccgacuuccccgggaagaccgucugguucgugcccagcaucaaguccggcaacgacaucgcgaacugccugcgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccucaagccggucauccugaaggacgggcccgagcgggugauccuggccggccccaugcccgugaccgucgcgagcgccgcccagcgccggggccgcaucgggcggaaccagaacaaggagggcgaccaguacguguacauggggcagccgcucaacaacgacgaggaccacgcccacuggaccgaggccaagaugcugcuggacaacaucaacacccccgagggcaucauccccgcccucuucgagcccgagcgcgagaaguccgccgccaucgacggggaguaccgccugcggggcgaggcccgcaagacguucguggagcugaugcggcgcggcgaccucccggucuggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggaccuacuccgacccccuggcccuccgcgaguucaaggaguucgccgccggccggcgcagcaucagcggcgaccugauccuggagaucgggaagcucccccagcaccugacccugcgggcccagaacgcgcucgacaaccuggugaugcugcacaacuccgagcagggcgggaaggccuaccgccacgccauggaggagcucccggacaccaucgagacgcugaugcugcucgcccugaucgcgguccugaccggcggggugacccucuucuuccugagcggcaagggccuggggaagaccuccaucggccuccugugcgugacggccagcuccgcccugcucuggauggccagcgucgagccccacuggaucgccgcguccaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagaccacgaagaaggaccuggggaucggccacguggccgcggagaaccaccagcacgccaccaugcucgacgucgaccugcggcccgccagcgccuggacccuguacgccguggcgaccacggugaucacccccaugaugcgccacaccaucgagaacaccacggccaacaucucccucaccgccaucgccaaccaggccgcgauccugaugggccuggacaagggguggccgaucagcaagauggacaucggcgucccccuccuggcccuggggugcuacucccaggugaacccccucacccugaccgccgccgugcugaugcucgucgcgcacuacgccaucaucggccccgggcugcaggccaaggccacgcgggaggcccagaagcgcaccgcggccggcaucaugaagaacccgaccguggacggcaucguggccaucgaccuggaccccgucguguacgacgccaaguucgagaagcagcucgggcagaucaugcugcugauccucugcaccagccagauccugcugaugcgcacgaccugggcccucugcgaguccaucacccuggcgaccggcccccugacgacccucugggaggggagccccggcaaguucuggaacaccaccaucgccguguccauggccaacaucuuccggggcagcuaccuggccggggccggccuggcguucucccucaugaagucccucgggggcgggcgccgggggacgggcgcccagggggagacccugggcgagaaguggaagcgccagcucaaccagcuguccaagagcgaguucaacaccuacaagcggagcgggaucauggaggucgaccgcuccgaggccaaggagggccugaagcgcggggagaccacgaagcacgccgugagccgcggcaccgcgaagcuccggugguucguggagcgcaaccuggucaagccggagggcaaggugaucgaccuggggugcggccgcggcgggugguccuacuacugcgccgggcugaagaaggugaccgaggucaagggguacaccaagggcgggcccggccacgaggagcccauccccauggccaccuacggguggaaccucgugaagcugcacagcggcaaggacguguucuucaugccgcccgagaagugcgacacgcugcucugcgacaucggggaguccagccccaaccccaccaucgaggagggccgcacccugcggguccugaagaugguggagccguggcuccgcggcaaccaguucugcaucaagauccugaaccccuacaugcccuccguggucgagacccuggagcagaugcagcggaagcacgggggcaugcucgugcgcaacccccugagccggaacuccacgcacgagauguacugggugagcugcgggaccggcaacaucgucuccgccgugaacaugaccagccgcaugcugcucaaccgguucaccauggcccaccgcaagccgacguacgagcgcgacguggaccugggcgcggggacccggcacgucgccguggagcccgagguggccaaccuggacaucaucggccagcgcaucgagaacaucaagaacgagcacaaguccaccuggcacuacgacgaggacaaccccuacaagaccugggccuaccacgggagcuacgaggucaagcccuccggcagcgccuccagcauggugaacggggugguccggcuccugacgaagccgugggacgugauccccauggugacccagaucgcgaugaccgacaccacgcccuucggccagcagcgcgucuucaaggagaagguggacacccggaccccgcgcgccaagcggggcaccacgcagaucauggaggucaccgccaaguggcuguggggguuccucucccgcaacaagaagccccggaucugcacccgcgaggaguucacccggaaggugcgcagcaacgccgccaucggcgcgguguucgucgacgagaaccaguggaacagcgccaaggaggccguggaggacgagcgguucugggaccuggugcaccgcgagcgggagcugcacaagcaggggaagugcgccacgugcgucuacaacaugaugggcaagcgcgagaagaagcucggggaguucggcaaggcgaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagauccccggcgggaacauguacgccgacgacaccgcgggcugggacacccggaucaccgaggacgaccugcagaacgaggccaagaucacggagaucauggagcccgagcacgcccuccuggccaccagcaucuucaagcugaccuaccagaacaaggugguccgcgugcagcgcccggccaagaacgggaccgugauggacgucaucucccggcgcgaccagcggggcagcggccagguggggacguacggccucaacaccuucaccaacauggaggugcagcugauccgccagauggaguccgaggggaucuuccugcccagcgagcucgagacccccaaccuggcggagcggguccuggacuggcucgagaagcacggcgccgagcgccugaagcggauggccaucuccggggacgacugcguggugaagcccaucgacgaccgcuucgccacggcccugaccgcgcucaacgacaugggcaagguccggaaggacaucccgcagugggagcccagcaagggcuggaacgacuggcagcagguccccuucugcucccaccacuuccaccagcugaucaugaaggacgggcgcgagaucgugguccccugccggaaccaggacgagcuggugggccgcgcccgggugagccagggggccggcuggucccuccgcgagaccgccugccugggcaagagcuacgcccagauguggcagcugauguacuuccaccggcgcgaccuccggcuggcggccaacgccaucugcuccgccgucccgguggacugggugcccaccagccgcaccacguggagcauccacgcgcaccaccaguggaugaccaccgaggacaugcuguccgucuggaaccggguguggaucgaggagaaccccuggauggaggacaagacccacgugagcuccugggaggagguccccuaccucggcaagcgcgaggaccaguggugcggcagccugaucgggcugacggcccgcgccaccugggccaccaacauccagguggccaucaaccaggugcggcgccucaucggcaacgagaacuaccuggacuacaugaccuccaugaagcgguucaagaacgagagcgacccggagggggcgcugugguga

SEQ ID NO: 8081 - RNA, 9879 nt, Artificial Sequence
  derived and/or modified CDS sequence (opt1) from DENV-1__GQ868513__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccgccgggacaagcgcuccguggcccuggcgccccacgugggccuggggcucgagacgcggaccgagaccuggaugagcagcgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcccaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagaucccguucuccacccaggacgagaagggggugacgcagaacggccgccucaucaccgccaaccccaucgugaccgacaaggagaagcccgucaacaucgagaccgagcccccguucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagccccaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggccggacacccccgagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucaucccgaagaucuacgggggccccaucucccagcacaacuaccggcccggguacuucacccagacggccggcccguggcaccuggggaagcucgagcuggacuucgaccugugcgagggcaccaccgucgugguggacgagcacugcggcaaccgcgggcccagccuccggaccacgaccgucaccggcaagaucauccacgaguggugcugccgcuccugcacccugccgccccugcgguuccgcggggaggacggcugcugguacgggauggagauccggccggugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggcccauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgugucccuguucccgcucugccugagcaccacgucccagaagaccaccuggcugcccguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccgcucgccgggccccugaucgccggcggcaugcugaucgccugcuacgucaucagcggguccagcgcggaccucucccuggagaaggccgccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacaccccguccccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagccggggaagaaccccaagaacgugcagaccaugcccggcaccuucaagacgcccgagggcgaggucggggccaucgcccuggacuucaagccgggcaccagcgggucccccaucgugaaccgggagggcaagaucgugggccuguacgggaacggcgucgugaccaccagcgggacguacguguccgccaucgcccaggcgaaggccagccaggagggcccccucccggagaucgaggacgaggucuucaagaagcgcaaccugaccaucauggaccugcaccccgggagcggcaagacccggcgcuaccuccccgccauggugcgggaggccaucaagcgcaagcugcggacccugauccucgcgcccacgcgcguggucgccuccgagauggccgaggcccugaagggcaugccgauccgcuaccagaccaccgccgucaagagcgagcacaccgggcgggagaucguggaccugaugugccacgcgacguucaccaugcgccuccugucccccguccgggugcccaacuacaacaugaucaucauggacgaggcccacuucaccgaccccgccagcaucgccgcccgcggcuacaucuccacccggguggggaugggcgaggcggccgccaucuucaugacggccaccccgcccgggagcgucgaggccuucccccaguccaacgcggugauccaggacgaggagcgcgacauccccgagcggagcuggaacuccggcuacgacuggaucaccgacuucccgggcaagaccgugugguucguccccagcaucaaguccgggaacgacaucgccaacugccugcgcaagaacggcaagcgggugauccagcucagccgcaagacguucgacaccgaguaccagaagaccaagaacaacgacugggacuacguggucaccacggacaucuccgagaugggggccaacuuccgggccgaccgcgugaucgacccccggcgcugccugaagcccgugauccugaaggacggcccggagcgggucauccucgcggggcccaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacaccccggaggggaucauccccgcccuguucgagcccgagcgcgagaaguccgccgccaucgacggcgaguaccgccugcgcggggaggcccgcaagacguucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccgcgcuggcuggacgcccggaccuacuccgacccccucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacgcugaugcuccuggcgcugaucgccguccucaccgggggcgugacccuguucuuccugagcgggaagggccucggcaagaccuccaucgggcugcugugcgugacggccagcuccgcccuccuguggauggccagcgucgagccgcacuggaucgcggccuccaucauccuggaguucuuccucauggugcugcugauccccgagcccgaccggcagcgcaccccgcaggacaaccagcucgccuacguggucaucggccugcuguucaugauccucaccguggccgccaacgagauggggcugcuggagaccacgaagaaggaccucggcaucgggcacguggcggccgagaaccaccagcacgccaccaugcuggacgucgaccugcggcccgccagcgccuggacccucuacgcgguggccaccacggugaucacccccaugaugcgccacaccaucgagaacaccacggccaacaucucccugaccgccaucgccaaccaggcggccauccugaugggccucgacaagggcuggcccaucagcaagauggacaucggggucccgcugcuggcccucggcugcuacucccaggugaacccccugacccugaccgccgcggugcucaugcuggucgcccacuacgccaucaucgggcccggccugcaggccaaggccacgcgggaggcgcagaagcgcaccgccgccgggaucaugaagaaccccaccguggacggcaucguggccaucgaccucgacccggucguguacgacgccaaguucgagaagcagcugggccagaucaugcugcucauccugugcaccagccagauccugcucaugcgcacgaccugggcgcugugcgaguccaucacccuggccaccgggccccucacgacccugugggagggcagccccgggaaguucuggaacaccaccaucgccguguccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagaccacgaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggcccggggcacgaggagcccauccccauggccaccuacggcuggaaccuggugaagcugcacagcgggaaggacguguucuucaugcccccggagaagugcgacacgcuccugugcgacaucggcgaguccagccccaaccccaccaucgaggaggggcgcacccugcggguccucaagaugguggagcccuggcugcgcggcaaccaguucugcaucaagauccugaacccguacaugcccuccguggucgagacccucgagcagaugcagcggaagcacggcgggaugcuggugcgcaacccccugagccggaacuccacgcacgagauguacugggugagcugcggcaccgggaacaucgucuccgccgugaacaugaccagccgcaugcuccugaaccgguucaccauggcgcaccgcaagcccacguacgagcgcgacguggaccugggcgccggcacccggcacgucgccguggagccggagguggccaaccucgacaucaucgggcagcgcaucgagaacaucaagaacgagcacaaguccaccuggcacuacgacgaggacaaccccuacaagaccugggccuaccacggcagcuacgaggucaagcccuccgggagcgcguccagcauggugaacggcgugguccggcugcugacgaagcccugggacgugaucccgauggucacccagaucgccaugaccgacaccacgcccuucgggcagcagcgcguguucaaggagaagguggacacccggacgccccgggccaagcggggcaccacgcagaucauggaggucaccgccaaguggcucuggggcuuccugucccgcaacaagaagccgcggaucugcacccgcgaggaguucacccggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgacgugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgcggacgacaccgccgggugggacacccggaucaccgaggacgaccuccagaacgaggccaagaucacggagaucauggagcccgagcacgcccugcuggccaccagcaucuucaagcucaccuaccagaacaaggugguccgcgugcagcgccccgcgaagaacggcaccgugauggacgucaucucccggcgcgaccagcgggggagcggccaggugggcacguacgggcugaacaccuucaccaacauggaggugcagcugauccgccagauggaguccgagggcaucuuccucccgagcgagcuggagacccccaaccuggccgagcggguccucgacuggcuggagaagcacggggccgagcgccugaagcggauggccaucuccggcgacgacugcguggugaagcccaucgacgaccgcuucgccacggcgcucaccgcccugaacgacauggggaagguccggaaggacaucccccagugggagccgagcaagggcuggaacgacuggcagcagguccccuucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcgguccccguggacugggugccgaccagccgcaccacguggagcauccacgcccaccaccaguggaugaccaccgaggacaugcucuccgucuggaaccggguguggaucgaggagaaccccuggauggaggacaagacccacgugagcuccugggaggagguccccuaccuggggaagcgcgaggaccaguggugcggcagccugaucggccucacggcccgcgccaccugggccaccaacauccagguggcgaucaaccaggugcggcgccugaucgggaacgagaacuaccuggacuacaugaccuccaugaagcgguucaagaacgagagcgaccccgagggcgcccucugguga

SEQ ID NO: 8082 - RNA, 9879 nt, Artificial Sequence
  derived and/or modified CDS sequence (opt1) from DENV-1__GU131973__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcgcgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagaugcggacccugauccuggcccccacccgcgucguggcguccgagauggccgaggcccucaagggcaugcccauccgcuaccagaccacggccgucaagagcgagcacaccgggcgggagaucgucgaccugaugugccacgccaccuucaccaugcgccugcucuccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcugagccgcaagaccuucgacaccgaguaccagaagacgaagaacaacgacugggacuacgucgugaccaccgacaucuccgagaugggggccaacuuccgggccgaccgcgugaucgacccccggcgcugccucaagcccgucauccugaaggacggccccgagcgggugauccuggccgggccgaugcccgugaccgucgcgagcgccgcccagcgccggggccgcaucggccggaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccgccugcgcggggaggcccgcaagaccuucgucgagcugaugcggcgcggcgaccuccccguguggcugagcuacaagguggccuccgagggcuuccaguacagcgaccggcgcuggugcuucgacggggagcggaacaaccagguccuggaggagaacauggacguggagaucuggaccaaggagggcgagcgcaagaagcuccggccccgcuggcuggacgcgcggaccuacuccgacccgcuggcccuccgcgaguucaaggaguucgccgccgggcggcgcagcgugagcggcgaccugauccuggagaucggcaagcucccccagcaccugacgcugcgggcccagaacgcgcucgacaaccuggucaugcugcacaacuccgagcagggcgggaaggccuaccgccacgccauggaggagcuccccgacaccaucgagacccugaugcugcucgcccugaucgcggugcugaccgggggcgugacccucuucuuccugagcgggaagggccugggcaagaccuccaucgggcuccugugcgucaccgccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucggccuccuguucaugauccugacgguggccgccaacgagauggggcuccuggagaccaccaagaaggaccugggcaucgggcacgucgccgcggagaaccaccagcacgccaccaugcucgacguggaccugcggccggccagcgccuggacgcuguacgccguggcgaccaccgucaucacccccaugaugcgccacacgaucgagaacaccaccgccaacaucucccucaccgccaucgccaaccaggccgcgauccugaugggccuggacaagggcuggcccaucagcaagauggacaucggggugccccuccuggcccugggcugcuacucccaggugaacccgcucacgcugaccgccgccguccugaugcucguggcgcacuacgccaucaucgggcccggccugcaggccaaggccacccgggaggcccagaagcgcaccgcggccgggaucaugaagaaccccacgguggacggcaucgucgccaucgaccuggaccccgugguguacgacgccaaguucgagaagcagcucggccagaucaugcugcugauccucugcaccagccagauccugcugaugcgcaccaccugggcccucugcgaguccaucacgcuggcgaccgggccgcugaccacccucugggagggcagccccgggaaguucuggaacacgaccaucgccgucuccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagagcgaguucaacacguacaagcggagcggcaucauggagguggaccgcuccgaggccaaggaggggcugaagcggggcgagaccaccaagcacgccgugagccgcgggaccgcgaagcuccggugguucgucgagcgcaaccuggugaagcccgagggcaaggugaucgaccugggcugcgggcggggcgggugguccuacuacugcgccggccugaagaaggucaccgaggugaagggguacacgaagggcggccccgggcacgaggagccgauccccauggccaccuacggcuggaaccucgugaagcugcacagcgggaaggacgucuucuucaugccgcccgagaagugcgacacccugcucugcgacaucggcgaguccagcccgaaccccaccaucgaggaggggcgcacgcugcgggugcugaagaugguggagcccuggcuccgcggcaaccaguucugcaucaagauccugaaccccuacaugccguccgucguggaggcccuggagcagaugcagcggaagcacggcgggaugcucgugcgcaacccccugagccggaacuccacccacgagauguacugggucagcugcggcaccgggaacaucguguccgccgugaacaugaccagccgcaugcugcucaaccgguucacgauggcgcaccgcaagcccaccuacgagcgcgacgucgaccugggcgccggcacccggcacguggccguggagcccgaggucgccaaccuggacaucaucgggcagcgcaucgagaacaucaagaacgagcacaaguccaccuggcacuacgacgaggacaacccguacaagacgugggccuaccacggcagcuacgaggugaagcccuccgggagcgcguccagcauggugaacggcgucgugcggcuccugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcuguggggcuuccucucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgcggacgacaccgccgggugggacacccggaucacggaggacgaccugcagaacgaggccaagaucaccgagaucauggagcccgagcacgcccuccuggccaccagcaucuucaagcugaccuaccagaacaaggucgugcgcgugcagcgccccgcgaagaacggcacggucauggacgugaucucccggcgcgaccagcgggggagcggccaggugggcaccuacgggcucaacaccuucaccaacauggagguccagcugauccgccagauggaguccgagggcaucuuccugcccagcgagcucgagacgccgaaccuggccgagcgggugcuggacuggcucgagaagcacggggccgagcgccugaagcggauggccaucuccggcgacgacugcguggucaagcccaucgacgaccgcuucgccaccgcgcugaccgcccucaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcugguggggcgcgcccgggucagccagggcgccggguggucccuccgcgagaccgccugccugggcaagagcuacgcgcagauguggcagcugauguacuuccaccggcgcgaccuccggcuggccgccaacgccaucugcuccgcggugcccguggacuggguccccaccagccgcacgaccuggagcauccacgcccaccaccaguggaugaccaccgaggacaugcuguccguguggaaccggguguggaucgaggagaacccguggauggaggacaagacgcacgucagcuccugggaggaggugcccuaccucgggaagcgcgaggaccaguggugcggcagccugaucggccugaccgcccgcgccaccugggccaccaacauccagguggcgaucaaccagguccggcgccucaucgggaacgagaacuaccuggacuacaugacguccaugaagcgguucaagaacgagagcgaccccgagggcgcccugugguga

SEQ ID NO: 8083 - RNA, 9879 nt, Artificial Sequence
  derived and/or modified CDS sequence (opt1) from DENV-1__GQ868517__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuuccucacccaggacgagaagggggugacgcagaacggccgccugaucaccgccaacccgaucgugaccgacaaggagaagcccgucaacaucgagaccgagccgcccuucggggaguccuacaucguggugggcgccggcgagaaggcgcugaagcucagcugguucaagaagggguccagcaucggcaagauguucgaggccacggcccgcggggcccgccggauggccauccugggcgacaccgcgugggacuucggguccaucggcggcgucuucaccagcguggggaagcuggugcaccaggucuucggcaccgccuacgggguccuguucuccggcgugagcuggacgaugaagaucgggaucggcauccugcugaccuggcucggccugaacucccgcagcaccucccugagcaugaccugcaucgccgucgggauggugacgcucuaccugggcgugaugguccaggccgacuccgggugcgugaucaacuggaagggccgcgagcugaagugcgggagcggcaucuucgugaccaacgagguccacaccuggaccgagcaguacaaguuccaggccgacuccccgaagcggcucagcgcggccaucggcaaggccugggaggagggggugugcggcauccgcagcgccacccggcuggagaacaucauguggaagcagaucuccaacgagcugaaccacauccuccuggagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcucaagcugcgcgacagcuacacccagaugugcgaccaccggcugauguccgcggccaucaaggacagcaaggccguccacgccgacaugggcuacuggaucgaguccgagaagaacgagaccuggaagcucgcccgcgcgagcuucaucgaggugaagacgugcaccuggcccaagucccacacccuguggagcaacggcgugcuggaguccgagaugaucauccccaagaucuacgggggcccgaucagccagcacaacuaccggcccggguacuucacccagacggccggccccuggcaccucgggaagcuggagcuggacuucgaccucugcgagggcaccaccgucgugguggacgagcacugcggcaaccgcgggccgucccugcggaccacgaccgucaccggcaagaucauccacgaguggugcugccgcagcugcacccugccgccccuccgguuccgcggggaggacggcugcugguacgggauggagauccggcccgugaaggagaaggaggagaaccuggugcgcuccauggucagcgccggcuccggcgagguggacagcuucagccuggggauccucugcgccuccaucaugaucgaggaggugaugcggagccgcuggucccggaagaugcugaugacgggcacccuggccgucuuccuccugcugaucauggggcagcucaccuggaacgaccugauccgccugugcaucauggugggcgcgaacgccagcgaccgcauggggaugggcaccacguaccucgcccugauggccaccuucaagaugcggccgauguucgccguggggcuccucuuccgccggcugaccucccgcgagguccugcuccugaccaucgggcugagccucguggcguccguggagcugcccaacagccuggaggagcucggcgacgggcuggccaugggcaucaugaugcugaagcuccugacggaguuccagccccaccagcuguggaccacccuccugucccugaccuucaucaagacgacccucagccuggacuacgccuggaagaccaccgccaugguccuguccaucgugagccucuucccccugugccuguccacgaccagccagaagaccaccuggcucccgguccugcugggcuccuucgggugcaagccccucaccauguuccugaucacggagaacaagaucuggggccgcaagagcuggccccugaacgaggggaucauggcgaucggcaucguguccauccuccugagcucccugcucaagaacgacgugccccuggccgggccgcugaucgccggcggcaugcucaucgccugcuacgucaucagcgggagcuccgccgaccugagccuggagaaggcggccgagguguccugggagcaggaggccgagcacagcggcaccucccacaacauccucguggagguccaggacgacgggaccaugaagaucaaggacgaggagcgcgacgacacccugacgauccugcucaaggccacccugcuggccgugagcggcguguaccccauguccauccccgcgacccucuucgucugguacuucuggcagaagaagaagcagcggagcggggugcugugggacacccccuccccgcccgagguggagcgcgccguccuggacgacggcaucuaccggauccugcagcgcggccuccuggggcggagccaggugggcgugggggucuuccaggacggcguguuccacacgauguggcacgugacccgcggggccguccugauguaccagggcaagcggcucgagcccuccugggccagcgugaagaaggaccugaucuccuacggcgggggcuggcgcuuccaggggagcuggaacaccggcgaggaggugcaggucaucgccguggagcccgggaagaacccgaagaacgugcagaccacgcccggcaccuucaagacccccgagggcgaggucggggcgaucgcccuggacuucaagcccggcaccuccgggagcccgaucgugaaccgggagggcaagaucgugggccucuacgggaacggcgucgugacgaccuccgggaccuacgugagcgccaucgcccaggccaaggcgucccaggagggcccccugcccgagaucgaggacgaggucuucaagaagcgcaaccugaccaucauggaccuccacccggggagcggcaagacgcggcgcuaccugcccgccaucgugcgggaggccaucaagcgcaagcugcggacccucauccuggcccccacccgcguggucgcgagcgagauggccgaggcccugaagggcaugcccauccgcuaccagaccacggccgugaaguccgagcacaccgggcgggagaucguggaccucaugugccacgccaccuucaccaugcgccugcugagcccgguccgggugcccaacuacaacaugaucaucauggacgaggcgcacuucacggaccccgccuccaucgccgcccgcggcuacaucagcacccggguggggaugggcgaggccgcggccaucuucaugaccgccacgccgcccggguccgucgaggccuucccccagagcaacgccgugauccaggacgaggagcgcgacauccccgagcgguccuggaacagcggcuacgacuggaucacggacuuccccggcaagaccgugugguucguccccuccaucaagagcgggaacgacaucgcgaacugccuccgcaagaacggcaagcgggugauccagcugucccgcaagaccuucgacaccgaguaccagaagacgaagaacaacgacugggacuacguggucaccaccgacaucagcgagaugggggccaacuuccgggccgaccgcgugaucgacccccggcgcugccugaagcccgugauccucaaggacggccccgagcgggucauccuggccgggccgaugcccgugaccguggcguccgccgcccagcgccggggccgcaucggccggaaccagaacaaggagggggaccaguacgucuacaugggccagccccugaacaacgacgaggaccacgcccacuggacggaggccaagaugcuccuggacaacaucaacacccccgaggggaucaucccggcgcuguucgagcccgagcgcgagaaguccgccgccaucgacggcgaguaccgccuccgcggggaggcccgcaagaccuucguggagcugaugcggcgcggcgaccugcccgucuggcucuccuacaagguggccagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcgcggaccuacagcgacccgcuggcccugcgcgaguucaaggaguucgccgccgggcggcgcuccgugagcggcgaccucauccuggagaucggcaagcugccccagcaccucacgcugcgggcccagaacgcgcuggacaaccucgugaugcugcacaacagcgagcagggcgggaaggccuaccgccacgccauggaggagcugcccgacaccaucgagacccucaugcugcuggcccucaucgcgguccugaccgggggcgugacgcuguucuuccucuccgggaagggccugggcaagaccagcaucgggcugcucugcgugaccgccuccagcgcccugcuguggauggccuccgucgagccccacuggaucgccgcgagcaucauccucgaguucuuccugauggugcugcucaucccggagcccgaccggcagcgcacgccccaggacaaccagcuggccuacguggucaucggccuccucuucaugauccugacgguggccgccaacgagauggggcugcucgagaccaccaagaaggaccugggcaucgggcacguggccgcggagaaccaccagcacgccaccaugcuggacgucgaccuccggccggccuccgccuggacgcuguacgccguggcgaccaccgugaucacccccaugaugcgccacacgaucgagaacaccaccgccaacaucagccugaccgccaucgccaaccaggccgcgauccucaugggccuggacaagggcuggcccaucuccaagauggacaucggggucccccugcucgcccugggcugcuacagccaggugaacccgcugacgcucaccgccgccgugcugaugcuggucgcgcacuacgccaucaucgggcccggccuccaggccaaggccacccgggaggcccagaagcgcaccgcggccgggaucaugaagaaccccacgguggacggcaucguggccaucgaccuggaccccgucguguacgacgccaaguucgagaagcagcugggccagaucaugcuccugauccugugcaccucccagauccuccugaugcgcaccaccugggcccugugcgagagcaucacgcucgcgaccgggccgcugaccacccugugggagggcucccccgggaaguucuggaacacgaccaucgccgugagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucagcaaguccgaguucaacacguacaagcggagcggcaucauggaggucgaccgcagcgaggccaaggaggggcugaagcggggcgagaccaccaagcacgccgugucccgcgggaccgcgaagcugcggugguucguggagcgcaaccuggucaagcccgagggcaaggugaucgaccucggcugcgggcggggcggguggagcuacuacugcgccggccugaagaaggugaccgaggucaagggguacacgaagggcggccccgggcacgaggagccgauccccauggccaccuacggcuggaaccuggugaagcuccacuccgggaaggacguguucuucaugccgcccgagaagugcgacacccugcugugcgacaucggcgagagcuccccgaaccccaccaucgaggaggggcgcacgcuccggguccugaagaugguggagcccuggcugcgcggcaaccaguucugcaucaagauccucaaccccuacaugccgagcguggucgagacccuggagcagaugcagcggaagcacggcgggaugcuggugcgcaacccccucucccggaacagcacccacgagauguacuggguguccugcggcaccgggaacaucgucagcgccgugaacaugacgucccgcaugcugcugaaccgguucaccauggcccaccgcaagcccaccuucgagcgcgacguggaccucggcgcgggcacccggcacgucgccguggagcccgagguggccaaccuggacaucaucgggcagcgcaucgagaacaucaagaacgagcacaagagcacguggcacuacgacgaggacaacccguacaagaccugggccuaccacggcuccuacgaggucaagcccagcggguccgccagcuccauggugaacggcgugguccggcugcucaccaagcccugggacgugauccccauggucacccagaucgcgaugacggacaccaccccguucgggcagcagcgcguguucaaggagaagguggacacccggacgccccgcgccaagcggggcaccacccagaucauggaggucaccgccaaguggcuguggggcuuccugagccgcaacaagaagccccggaucugcacgcgcgaggaguucacccggaaggugcgcuccaacgccgccaucggggcgguguucgucgacgagaaccaguggaacagcgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagaucccgggcggcaacauguacgccgacgacaccgcggggugggacacgcggaucaccgaggacgaccugcagaacgaggccaagaucaccgacaucauggagcccgagcacgcccugcucgccaccuccaucuucaagcugacguaccagaacaaggugguccgcgugcagcgccccgccaagaacggcaccgugauggacgucaucagccggcgcgaccagcggggguccggccaggugggcaccuacgggcugaacaccuucacgaacauggaggugcagcucauccgccagauggagagcgagggcaucuuccugcccuccgagcuggagaccccgaaccucgcggagcggguccuggacuggcuggagaagcacggggccgagcgccucaagcggauggccaucagcggcgacgacugcguggugaagcccaucgacgaccgcuucgccaccgcccugaccgcgcugaacgacauggggaagguccggaaggacaucccccagugggagcccuccaagggcuggaacgacuggcagcaggucccguucugcagccaccacuuccaccagcucaucaugaaggacggccgcgagaucgugguccccugccggaaccaggacgagcugguggggcgcgcccgggugucccagggcgccggguggagccugcgcgagaccgccugccucggcaaguccuacgcccagauguggcagcugauguacuuccaccggcgcgaccugcggcucgcggccaacgccaucugcagcgccguccccguggacugggugcccacgucccgcaccaccuggagcauccacgcgcaccaccaguggaugaccacggaggacaugcugagcgucuggaaccggguguggaucgaggagaacccguggauggaggacaagacccacguguccagcugggaggagguccccuaccuggggaagcgcgaggaccaguggugcggcucccucaucggccugaccgcccgcgccaccugggccacgaacauccagguggccaucaaccaggugcggcgccugaucgggaacgagaacuaccucgacuacaugaccagcaugaagcgguucaagaacgaguccgaccccgagggcgcgcugugguga

SEQ ID NO: 8084 - RNA, 9879 nt, Artificial Sequence
  derived and/or modified CDS sequence (opt1) from DENV-1__GU131976__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagccucaugaucgaggaggugaugcggucccgcuggagccggaagaugcugaugacgggcacccuggccgucuuccuccugcugaucauggggcagcucaccuggaacgaccugauccgccugugcaucauggugggcgcgaacgccuccgaccgcauggggaugggcaccacguaccucgcccugauggccaccuucaagaugcggccgauguucgccguggggcuccuguuccgccggcugaccagccgcgagguccugcuccugaccaucgggcugucccucguggcgagcguggagcugcccaacucccuggaggagcucggcgacgggcuggccaugggcaucaugaugcugaagcuccugacggaguuccagccccaccagcuguggaccacccuccugagccugaccuucaucaagacgacccucucccuggacuacgccuggaagaccaccgccauggcgcugagcaucgucucccucuucccccugugccugagcacgaccucccagaagaccaccuggcucccggugcugcugggcagcuucgggugcaagccccucaccauguuccugaucacggagaacaagaucuggggccggaaguccuggccccugaacgaggggaucauggccaucggcaucgucagcauccuccuguccagccugcucaagaacgacgugccccuggccgggccgcugaucgccggcggcaugcucaucgccugcuacgugaucagcggguccagcgcggaccugucccuggagaaggccgccgaggucagcugggagcaggaggccgagcacuccggcaccagccacaacauccucguggaggugcaggacgacgggaccaugaagaucaaggacgaggagcgcgacgacacccugacgauccugcucaaggccacccugcuggcggucuccggcguguaccccaugagcauccccgccacccucuucgugugguacuucuggcagaagaagaagcagcgguccgggguccugugggacacccccagcccgcccgagguggagcgcgccgugcuggacgacggcaucuaccggauccugcagcgcggccuccuggggcggucccaggucggcguggggguguuccaggacggcgucuuccacacgauguggcacgugacccgcggggccgugcugauguaccagggcaagcggcucgagcccagcugggccuccgucaagaaggaccugaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccucuacgggaacggcguggucacgaccagcgggaccuacguguccgccaucgcccaggcgaaggccagccaggagggcccccugcccgagaucgaggacgagguguucaagaagcgcaaccugaccaucauggaccuccacccggggagcggcaagacgcggcgcuaccugcccgccaucguccgggaggccaucaagcgcaagcugcggacccucauccuggcgcccacccgcgugguggccuccgagauggccgaggcccugaagggcaugcccauccgcuaccagaccacggccgucaagagcgagcacaccgggcgggagaucguggaccucaugugccacgcgaccuucaccaugcgccugcuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccuccgcaagaacggcaagcgggucauccagcugagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccucaaggacggccccgagcgggugauccuggcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcuccuggacaacaucaacacccccgaggggaucaucccggcccuguucgagcccgagcgcgagaaguccgccgccaucgacggcgaguaccgccuccgcggggaggcccgcaagaccuucgucgagcugaugcggcgcggcgaccugcccguguggcucagcuacaaggucgcguccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcccggaccuacuccgacccgcuggcccugcgcgaguucaaggaguucgccgccgggcggcgcagcgucagcggcgaccucauccuggagaucggcaagcugccccagcaccucacgcugaaggcgcagaacgcccuggacaaccucgugaugcugcacaacuccgagcagggcgggaaggccuaccggcacgccauggaggagcugcccgacaccaucgagacccucaugcugcuggcgcucaucgccgugcugaccgggggcgucacgcuguucuuccucagcgggaagggccugggcaagaccuccaucgggcugcucugcgugaccgccagcuccgcccugcuguggauggccagcguggagccccacuggaucgcggccuccaucauccucgaguucuuccugaugguccugcucaucccggagcccgaccgccagcggacgccccaggacaaccagcuggccuacguggugaucggccuccucuucaugauccugacggucgccgccaacgagauggggcugcucgagaccaccaagaaggaccugggcaucgggcacguggcggccgagaaccaccagcacgccaccaugcuggacguggaccuccgcccggccagcgccuggacgcuguacgcggucgccaccaccgugaucacccccaugaugcggcacacgaucgagaacaccaccgccaacaucucccugaccgccaucgccaaccaggcggccauccucaugggccuggacaagggcuggcccaucagcaagauggacaucggggugccccugcucgcccugggcugcuacucccaggucaacccgcugacgcucaccgccgcggugcugaugcugguggcccacuacgccaucaucgggcccggccuccaggccaaggccacccgcgaggcgcagaagcggaccgccgccgggaucaugaagaaccccacggucgacggcaucguggccaucgaccuggaccccguggucuacgacgccaaguucgagaagcagcugggccagaucaugcuccugauccugugcaccagccagauccuccugaugcgcaccaccugggcgcugugcgaguccaucacgcucgccaccgggccgcugaccacccugugggagggcagccccgggaaguucuggaacacgaccaucgccguguccauggccaacaucuuccgcggcagcuaccucgccggcgcggggcuggccuucucccugaugaagucccucggcgggggccggcgcgggaccggcgcccagggcgagacccugggggagaaguggaagcggcagcugaaccagcucuccaagagcgaguucaacacguacaagcgcagcggcaucauggagguggaccgguccgaggccaaggaggggcugaagcgcggcgagaccaccaagcacgcggucagccgggggaccgccaagcugcgcugguucguggagcggaaccuggugaagcccgagggcaaggucaucgaccucggcugcgggcgcggcgggugguccuacuacugcgccggccugaagaaggugaccgaggugaagggguacacgaagggcggccccgggcacgaggagccgauccccauggccaccuacggcuggaaccuggucaagcuccacagcgggaaggacguguucuucaugccgcccgagaagugcgacacccugcugugcgacaucggcgaguccagcccgaaccccaccaucgaggaggggcggacgcuccgcgugcugaagauggucgagcccuggcugcggggcaaccaguucugcaucaagauccucaaccccuacaugccguccgugguggagacccuggagcagaugcagcgcaagcacggcgggaugcugguccggaacccccucagccgcaacuccacccacgagauguacugggugagcugcggcaccgggaacaucguguccgccgucaacaugacgagccggaugcugcugaaccgcuucaccauggcgcaccggaagcccaccuucgagcgcgacguggaccucggcgccggcacccgccacguggccgucgagcccgagguggccaaccuggacaucaucgggcagcggaucgagaacaucaagaacgagcacaaguccacguggcacuacgacgaggacaacccguacaagaccugggccuaccacggcagcuacgaggugaagcccuccgggagcgcguccagcauggucaacggcguggugcgccugcucaccaagcccugggacgucauccccauggugacccagaucgccaugacggacaccaccccguucgggcagcagcgggucuucaaggagaagguggacacccgcacgccccgggccaagcgcggcaccacccagaucauggaggugaccgccaaguggcuguggggcuuccugucccggaacaagaagccccgcaucugcacgcgggaggaguucacccgcaagguccggagcaacgccgcgaucggggccguguucguggacgagaaccaguggaacagcgccaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggcgcccgguuccuggaguucgaggcccugggguucaugaacgaggaccacugguucagccgcgagaacucccucagcggcgucgagggggagggccugcacaagcugggguacauccuccgggacaucuccaagaucccgggcggcaacauguacgcggacgacaccgccgggugggacacgcgcaucaccgaggacgaccugcagaacgaggccaagaucaccgacaucauggagcccgagcacgcccugcucgccaccagcaucuucaagcugacguaccagaacaagguggugcggguccagcgccccgcgaagaacggcaccgugauggacgugaucucccgccgggaccagcgcgggagcggccaggucggcaccuacgggcugaacaccuucacgaacauggaggugcagcucauccggcagauggaguccgagggcaucuuccugcccagcgagcuggagaccccgaaccucgccgagcgcgugcuggacuggcuggagaagcacgggaccgagcggcucaagcgcauggccaucuccggcgacgacugcgucgugaagcccaucgacgaccgguucgccaccgcccugaccgcgcugaacgacauggggaaggugcgcaaggacaucccccagugggagcccagcaagggcuggaacgacuggcagcaggucccguucugcucccaccacuuccaccagcucaucaugaaggacggccgggagaucguggugcccugccgcaaccaggacgagcuggucgggcgggcccgcgugagccagggcgccggguggucccugcgggagacggccugccucggcaagagcuacgcccagauguggcagcugauguacuuccaccgccgggaccugcgccucgcggccaacgccaucugcuccgccgugcccgucgacugggugcccaccagccggaccaccuggagcauccacgcgcaccaccaguggaugacgaccgaggacaugcuguccguguggaaccgcgucuggaucgaggagaacccguggauggaggacaagacccacgugagcuccugggaggaggugcccuaccuggggaagcgggaggaccaguggugcggcagccucaucggccugaccgcccgcgccacgugggccaccaacauccaggucgccaucaaccaggugcgccggcugaucgggaacgagaacuaccucgacuacaugaccuccaugaagcgcuucaagaacgagagcgaccccgagggcgcgcugugguga

SEQ ID NO: 8085 - RNA, 9879 nt, Artificial Sequence
  derived and/or modified CDS sequence (opt1) from DENV-1__GQ868518__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggccccagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacaccccguccccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccggggguccuggaacaccggcgaggaggugcaggucaucgcgguggagccggggaagaaccccaagaacgugcagaccacccccggcacguucaagacccccgagggcgaggucggggccaucgcccuggacuucaagccgggcaccagcgggucccccaucgugaaccgcgagggcaagaucgugggccuguacgggaacggcgucgugaccacgagcgggaccuacguguccgccaucgcccaggcgaaggccagccaggagggcccccucccggagaucgaggacgaggucuucaagaagcggaaccugaccaucauggaccugcaccccgggagcggcaagacccgccgguaccuccccgccaucgugcgcgaggccaucaagcggaagcugcgcacgcugauccucgcgcccacccgcguggucgccuccgagauggccgaggcccugaagggcaugccgauccgguaccagaccaccgccgucaagagcgagcacacggggcgcgagaucguggaccugaugugccacgcgaccuucaccaugcggcuccugucccccguccgcgugcccaacuacaacaugaucaucauggacgaggcccacuucaccgaccccgccagcaucgccgcccggggcuacaucuccacgcgcguggggaugggcgaggcggccgccaucuucaugaccgccaccccgcccgggagcgucgaggccuucccccaguccaacgcggugauccaggacgaggagcgggacauccccgagcgcagcuggaacuccggcuacgacuggaucaccgacuucccgggcaagacggugugguucguccccagcaucaaguccgggaacgacaucgccaacugccugcggaagaacggcaagcgcgugauccagcucagccggaagaccuucgacaccgaguaccagaagaccaagaacaacgacugggacuacguggucacgaccgacaucuccgagaugggggccaacuuccgcgccgaccgggugaucgacccccgccggugccugaagcccgugauccugaaggacggcccggagcgcgucauccucgcggggcccaugcccgugaccguggccagcgccgcccagcggcgcggccggaucggccgcaaccagaacaaggagggggaccaguacgucuacaugggccagccccugaacaacgacgaggaccacgcccacuggaccgaggcgaagaugcugcucgacaacaucaacacgccggaggggaucauccccgcccuguucgagcccgagcgcgagaaguccgccgccaucgacggcgaguaccggcugcgcggggaggcccggaagaccuucguggagcucaugcgccggggcgaccugcccgucuggcugagcuacaagguggcguccgagggcuuccaguacagcgaccgccgguggugcuucgacggggagcgcaacaaccaggugcucgaggagaacauggacgucgagaucuggaccaaggagggcgagcggaagaagcugcgcccgcgguggcuggacgcccgcaccuacuccgacccccucgcccugcgggaguucaaggaguucgccgccgggcgccggagcgugagcggcgaccugauccucgagaucggcaagcugccccagcaccugaccucccgcgcgcagaacgcccucgacaaccuggugaugcugcacaacagcgagcagggcgggaaggccuaccggcacgccauggaggagcuccccgacacgaucgagacccugaugcugcucgcgcugaucgccguccugaccgggggcgugacccucuucuuccuguccgggaagggccugggcaagacgagcaucgggcuccugugcgugaccgccuccagcgcccugcucuggauggccuccgucgagccgcacuggaucgcggccagcaucauccuggaguucuuccugauggugcuccugauccccgagcccgaccgccagcggaccccgcaggacaaccagcuggccuacguggucaucggccuccuguucaugauccugaccguggccgccaacgagauggggcuccuggagacgaccaagaaggaccugggcaucgggcacguggcggccgagaaccaccagcacgccaccaugcucgacgucgaccugcgccccgccuccgccuggacccuguacgcgguggccacgaccgugaucacccccaugaugcggcacaccaucgagaacacgaccgccaacaucagccucaccgccaucgccaaccaggcggccauccugaugggccuggacaagggcuggcccaucuccaagauggacaucggggucccgcuccuggcccugggcugcuacagccaggugaacccccucacccugacggccgcggugcugaugcucgucgcccacuacgccaucaucgggcccggccugcaggccaaggccacccgcgaggcgcagaagcgcaccgccgccgggaucaugaagaaccccaccguggacggcaucguggccaucgaccuggacccggucguguacgacgccaaguucgagaagcagcucggccagaucaugcugcugauccucugcacgucccagauccugcugaugcggaccaccugggcgcucugcgagagcaucacccuggccacggggccccugaccacccucugggagggcucccccgggaaguucuggaacaccacgaucgccgugagcauggccaacaucuuccgcggcuccuaccuggccggcgcggggcuggccuucagccucaugaagucccugggcgggggccggcgcgggaccggcgcccagggcgagacccugggggagaaguggaagcggcagcucaaccagcugagcaagagcgaguucaacaccuacaagcgcuccggcaucauggaggucgaccggagcgaggccaaggaggggcugaagcgcggcgagacgaccaagcacgcggugucccgggggaccgccaagcuccgcugguucguggagcggaaccuggucaagcccgagggcaaggugaucgaccugggcugcgggcgcggcggguggagcuacuacugcgccggccugaagaaggugaccgaggucaagggguacaccaagggcggcccggggcacgaggagcccauccccauggccacguacggcuggaaccucgugaagcugcacuccgggaaggacguguucuucaugcccccggagaagugcgacacccugcucugcgacaucggcgagagcucccccaaccccaccaucgaggaggggcggacccugcgcguccugaagaugguggagcccuggcuccggggcaaccaguucugcaucaagauccugaacccguacaugcccagcguggucgagacgcuggagcagaugcagcgcaagcacggcgggaugcucgugcggaacccccugucccgcaacagcacccacgagauguacuggguguccugcggcaccgggaacaucgucagcgccgugaacaugaccucccggaugcugcucaaccgcuucacgauggcgcaccgcaagcccaccuacgagcgggacguggaccugggcgccggcacccgccacgucgccguggagccggagguggccaaccuggacaucaucgggcagcggaucgagaacaucaagaacgagcacaagagcaccuggcacuacgacgaggacaaccccuacaagacgugggccuaccacggcuccuacgaggucaagcccagcggguccgcgagcuccauggugaacggcgugguccgccuccugaccaagcccugggacgugaucccgauggucacccagaucgccaugaccgacacgacccccuucgggcagcagcggguguucaaggagaagguggacacccgcacgccccgggccaagcgcggcacgacccagaucauggaggucaccgccaaguggcuguggggcuuccucagccggaacaagaagccgcgcaucugcacccgggaggaguucacgcgcaaggugcggagcaacgccgcgaucggggccguguucgucgacgagaaccaguggaacuccgccaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgcggacgacaccgccgggugggacacccgcaucacggaggacgaccugcagaacgaggccaagaucaccgagaucauggagcccgagcacgcccuccuggccaccuccaucuucaagcugaccuaccagaacaaggugguccgcgugcagcggcccgcgaagaacggcacggugauggacgucaucagccgccgggaccagcgcggguccggccaggugggcaccuacgggcucaacaccuucaccaacauggaggugcagcugauccggcagauggagagcgagggcaucuuccugccguccgagcucgagacgcccaaccuggccgagcgcguccuggacuggcucgagaagcacggggccgagcggcugaagcgcauggccaucagcggcgacgacugcguggugaagcccaucgacgaccgguucgccaccgcgcugaccgcccucaacgacauggggaagguccgcaaggacaucccccagugggagccguccaagggcuggaacgacuggcagcagguccccuucugcagccaccacuuccaccagcugaucaugaaggacggccgggagaucgugguccccugccgcaaccaggacgagcugguggggcgggcccgcgugucccagggcgccggguggagccuccgggagaccgccugccugggcaaguccuacgcgcagauguggcagcugauguacuuccaccgccgggaccuccgccuggccgccaacgccaucugcagcgcgguccccguggacugggugccgaccagccggacgaccugguccauccacgcccaccaccaguggaugaccaccgaggacaugcugagcgucuggaaccgcguguggaucgaggagaaccccuggauggaggacaagacgcacguguccagcugggaggagguccccuaccucgggaagcgcgaggaccaguggugcggcucccugaucggccugaccgcccgggccaccugggccaccaacauccagguggcgaucaaccaggugcgccggcucaucgggaacgagaacuaccuggacuacaugacgagcaugaagcgcuucaagaacgaguccgaccccgagggcgcccugugguga

SEQ ID NO: 8086 - RNA, 9879 nt, Artificial Sequence
  derived and/or modified CDS sequence (opt1) from DENV-1__GQ868519__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuuccucacccaggacgagaagggggugacgcagaacggccgccugaucaccgccaacccgaucgugaccgacaaggagaagcccgucaacaucgagaccgagccgcccuucggggaguccuacaucguggugggcgccggcgagaaggcgcugaagcucagcugguucaagaagggguccagcaucggcaagauguucgaggccacggcccgcggggcccgccggauggccauccugggcgacaccgcgugggacuucggguccaucggcggcgucuucaccagcguggggaagcuggugcaccaggucuucggcaccgccuacgggguccuguucuccggcgugagcuggacgaugaagaucgggaucggcauccugcugaccuggcucggccugaacucccgcagcaccucccugagcaugaccugcaucgccgucgggauggugacgcucuaccugggcgugaugguccaggccgacuccgggugcgugaucaacuggaagggccgcgagcugaagugcgggagcggcaucuucgugaccaacgagguccacaccuggaccgagcaguacaaguuccaggccgacuccccgaagcggcucagcgcggccaucggcaaggccugggaggagggggugugcggcauccgcagcgccacccggcuggagaacaucauguggaagcagaucuccaacgagcugaaccacauccuccuggagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcucaagcugcgcgacagcuacacccagaugugcgaccaccggcugauguccgcggccaucaaggacagcaaggccguccacgccgacaugggcuacuggaucgaguccgagaagaacgagaccuggaagcucgcccgcgcgagcuucaucgaggugaagacgugcaccuggcccaagucccacacccuguggagcaacggcgugcuggaguccgagaugaucauccccaagaucuacgggggcccgaucagccagcacaacuaccggcccggguacuucacccagacggccggccccuggcaccucgggaagcuggagcuggacuucgaccucugcgagggcaccaccgucgugguggacgagcacugcggcaaccgcgggccgucccugcggaccacgaccgucaccggcaagaucauccacgaguggugcugccgcagcugcacccugccgccccuccgguuccgcggggaggacggcugcugguacgggauggagauccggcccgugaaggagaaggaggagaaccuggugcgcuccauggucagcgccggcuccggcgagguggacagcuucagccuggggauccucugcgccuccaucaugaucgaggaggugaugcggagccgcuggucccggaagaugcugaugacgggcacccuggccgucuuccuccugcuggugauggggcagcucaccuggaacgaccugauccgccugugcaucauggugggcgcgaacgccagcgaccgcauggggaugggcaccacguaccucgcccugauggccaccuucaagaugcggccgauguucgccgucgggcuccucuuccgccggcugaccucccgcgaggugcugcuccugaccaucgggcugagccucguggcguccgucgagcugcccaacagccuggaggagcucggcgacgggcuggccaugggcaucaugaugcugaagcuccugacggaguuccagccccaccagcuguggaucacccuccugucccugaccuucaucaagaccacgcucagccuggacuacgccuggaagaccaccgccauggcgcuguccaucgugagccucuucccccugugccuguccaccacgagccagaagaccaccuggcucccgguccugcugggcuccuucgggugcaagccccucaccauguuccugaucaccgagaacaagaucuggggccgcaagagcuggccccugaacgaggggaucauggccaucggcaucguguccauccuccugagcucccugcucaagaacgacgugccccuggccgggccgcugaucgccggcggcaugcucaucgccugcuacgucaucagcgggagcuccgcggaccugagccuggagaaggccgccgagguguccugggagcaggaggccgagcacagcggcacgucccacaacauccucguggagguccaggacgacgggaccaugaagaucaaggacgaggagcgcgacgacacccugaccauccugcucaaggccacgcugcuggcggugagcggcguguaccccauguccauccccgccacccucuucgucugguacuucuggcagaagaagaagcagcggagcggggugcugugggacacccccuccccgcccgagguggagcgcgccguccuggacgacggcaucuaccggauccugcagcgcggccuccuggggcggagccaggugggcgugggggucuuccaggacggcguguuccacaccauguggcacgugacgcgcggggccguccugauguaccagggcaagcggcucgagcccuccugggccagcgugaagaaggaccugaucuccuacggcgggggcuggcgcuuccaggggagcuggaacaccggcgaggaggugcaggucaucgcgguggagcccgggaagaacccgaagaacgugcagaccaugcccggcaccuucaagacgcccgagggcgaggucggggccaucgcccuggacuucaagcccggcaccuccgggagcccgaucgugaaccgggagggcaagaucgugggccucuacgggaacggcgucgugaccaccuccgggacguacgugagcgccaucgcccaggcgaaggccucccaggagggcccccugcccgagaucgaggacgaggucuucaagaagcgcaaccugaccaucauggaccuccacccggggagcggcaagacccggcgcuaccugcccgccauggugcgggaggccaucaagcgcaagcugcggacccucauccuggcgcccacgcgcguggucgccagcgagauggccgaggcccugaagggcaugcccauccgcuaccagaccaccgccgugaaguccgagcacaccgggcgggagaucguggaccucaugugccacgcgacguucaccaugcgccugcugagcccgguccgggugcccaacuacaacaugaucaucauggacgaggcccacuucaccgaccccgccuccaucgccgcccgcggcuacaucagcacccggguggggaugggcgaggcggccgccaucuucaugacggccacgccgcccggguccgucgaggccuucccccagagcaacgcggugauccaggacgaggagcgcgacauccccgagcgguccuggaacagcggcuacgacuggaucaccgacuuccccggcaagaccgugugguucguccccuccaucaagagcgggaacgacaucgccaacugccuccgcaagaacggcaagcgggugauccagcugucccgcaagacguucgacaccgaguaccagaagaccaagaacaacgacugggacuacguggucaccacggacaucagcgagaugggggccaacuuccgggccgaccgcgugaucgacccccggcgcugccugaagcccgugauccucaaggacggccccgagcgggucauccuggcggggccgaugcccgugaccguggccuccgccgcccagcgccggggccgcaucggccggaaccagaacaaggagggggaccaguacgucuacaugggccagccccugaacaacgacgaggaccacgcccacuggaccgaggcgaagaugcuccuggacaacaucaacacccccgaggggaucaucccggcccuguucgagcccgagcgcgagaaguccgccgccaucgacggcgaguaccgccuccgcggggaggcccgcaagacguucguggagcugaugcggcgcggcgaccugcccgucuggcucuccuacaagguggcgagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcccggaccuacagcgacccgcuggcccugcgcgaguucaaggaguucgccgccgggcggcgcuccgugagcggcgaccucauccuggagaucggcaagcugccccagcaccucacccugcgggcgcagaacgcccuggacaaccucgugaugcugcacaacagcgagcagggcgggaaggccuaccgccacgccauggaggagcugcccgacaccaucgagacgcucaugcugcuggcgcucaucgccguccugaccgggggcgugacccuguucuuccucuccgggaagggccugggcaagaccagcaucgggcugcucugcgugacggccuccagcgcccugcuguggauggccuccgucgagccccacuggaucgcggccagcaucauccucgaguucuuccugauggugcugcucaucccggagcccgaccggcagcgcacgccccaggacaaccagcuggccuacguggucaucggccuccucuucaugauccugaccguggccgccaacgagauggggcugcucgagaccacgaagaaggaccugggcaucgggcacguggcggccgagaaccaccagcacgccaccaugcuggacgucgaccuccggccggccuccgccuggacccuguacgcgguggccaccacggugaucacccccaugaugcgccacaccaucgagaacaccacggccaacaucagccugaccgccaucgccaaccaggcggccauccucaugggccuggacaagggcuggcccaucuccaagauggacaucggggucccccugcucgcccugggcugcuacagccaggugaacccgcugacccucaccgccgcggugcugaugcuggucgcccacuacgccaucaucgggcccggccuccaggccaaggccacgcgggaggcgcagaagcgcaccgccgccgggaucaugaagaaccccaccguggacggcaucguggccaucgaccuggaccccgucguguacgacgccaaguucgagaagcagcugggccagaucaugcuccugauccugugcaccucccagauccuccugaugcgcacgaccugggcgcugugcgagagcaucacccucgccaccgggccgcugacgacccugugggagggcucccccgggaaguucuggaacaccaccaucgccgugagcauggccaacaucuuccggggcuccuaccucgccggcgcggggcuggccuucagccugaugaagucccucggcgggggccgccgggggacgggcgcccagggcgagacccugggggagaaguggaagcgccagcugaaccagcucagcaaguccgaguucaacaccuacaagcggagcggcaucauggaggucgaccgcagcgaggccaaggaggggcugaagcggggcgagaccacgaagcacgcggugucccgcgggaccgccaagcugcggugguucguggagcgcaaccuggucaagcccgagggcaaggugaucgaccucggcugcgggcggggcggguggagcuacuacugcgccggccugaagaaggugaccgaggucaagggguacaccaagggcggccccgggcacgaggagccgauccccauggccaccuacggcuggaaccuggugaagcuccacuccgggaaggacguguucuucaugccgcccgagaagugcgacacgcugcugugcgacaucggcgagagcuccccgaaccccaccaucgaggaggggcgcacccuccggguccugaagaugguggagcccuggcugcgcggcaaccaguucugcaucaagauccucaaccccuacaugccgagcguggucgagacccuggagcagaugcagcggaagcacggcgggaugcuggugcgcaacccccucucccggaacagcacgcacgagauguacuggguguccugcggcaccgggaacaucgucagcgccgugaacaugaccucccgcaugcugcugaaccgguucaccauggcgcaccgcaagcccacguacgagcgcgacguggaccucggcgccggcacccggcacgucgccguggagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgcgagcuccauggugaacggcgugguccggcugcucacgaagcccugggacgugauccccauggucacccagaucgccaugaccgacaccacgccguucgggcagcagcgcguguucaaggagaagguggacacccggacgccccgggccaagcggggcaccacgcagaucauggaggucaccgccaaguggcuguggggcuuccugagccgcaacaagaagccccggaucugcacccgcgaggaguucacccggaaggugcgcuccaacgccgcgaucggggccguguucgucgacgagaaccaguggaacagcgccaaggaggccguggaggacgagcgguucugggaccucgugcaccgcgagcgggagcugcacaagcagggcaagugcgcgacgugcgucuacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagaucccgggcggcaacauguacgcggacgacaccgccgggugggacacccggaucaccgaggacgaccugcagaacgaggccaagaucacggagaucauggagcccgagcacgcccugcucgccaccuccaucuucaagcugaccuaccagaacaaggugguccgcgugcagcgccccgcgaagaacggcaccgugauggacgucaucagccggcgcgaccagcggggguccggccaggugggcacguacgggcugaacaccuucaccaacauggaggugcagcucauccgccagauggagagcgagggcaucuuccugcccuccgagcuggagaccccgaaccucgccgagcggguccuggacuggcuggagaagcacggggccgagcgccucaagcggauggccaucagcggcgacgacugcguggugaagcccaucgacgaccgcuucgccacggcgcugaccgcccugaacgacauggggaagguccggaaggacaucccccagugggagcccuccaagggcuggaacgacuggcagcaggucccguucugcagccaccacuuccaccagcucaucaugaaggacggccgcgagaucgugguccccugccggaaccaggacgagcugguggggcgcgcccgggugucccagggcgccggguggagccugcgcgagaccgccugccucggcaaguccuacgcgcagauguggcagcugauguacuuccaccggcgcgaccugcggcucgccgccaacgccaucugcagcgcgguccccguggacugggugcccaccucccgcaccacguggagcauccacgcccaccaccaguggaugaccaccgaggacaugcugagcgucuggaaccggguguggaucgaggagaacccguggauggaggacaagacccacguguccagcugggaggagguccccuaccuggggaagcgcgaggaccaguggugcggcucccucaucggccugacggcccgcgccaccugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8087 - RNA, 9879 nt, Artificial Sequence
  derived and/or modified CDS sequence (opt1) from DENV-1__KF955443__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaugagcggcaccaccaccaucuucgccgggcaccugaagugccggcugaagauggacaagcucacgcugaagggcaccuccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcugagcgcggccaucggcaaggccugggaggagggggugugcggcauccgcuccgugacccggcucgagaacaucauguggaagcagaucagcaacgagcugaaccacauccugcucgagaacgacaugaaguucaccgucguggugggggacgccaacggcauccuggcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacaaccagcgggccuggaacaucugggaggucgaggacuacggcuucgggaucuucaccacgaacaucuggcugaagcuccgcgacuccuacacccagaugugcgaccaccggcugaugagcgccgcgaucaaggacuccaaggccgugcacgccgacaugggcuacuggaucgagagcgagaagaacgagaccuggaagcuggcccgcgccuccuucaucgaggugaagaccugcacguggcccaagagccacacccucugguccaacggcguccuggagagcgagaugaucauccccaagaucuacgggggcccgaucucccagcacaacuaccggcccggguacuucacccagaccgcgggccccuggcaccuggggaagcucgagcuggacuucgaccugugcgagggcacgaccgugguggucgacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgccagcaucaugaucgaggaggucaugcggucccgcuggagccggaagaugcucaugaccggcacgcuggccguguuccugcuccugaucauggggcagcugaccuggaacgaccucauccgccugugcaucauggugggcgccaacgcguccgaccgcauggggaugggcaccaccuaccuggcccucauggccacguucaagaugcggccgauguucgccgucgggcugcuguuccgccggcucaccagccgcgaggugcugcugcucaccaucgggcugucccugguggccagcgucgagcuccccaacucccuggaggagcugggcgacgggcucgcgaugggcaucaugaugcugaagcugcucaccgaguuccagccccaccagcuguggacgacccugcucagccugaccuucaucaagaccacgcugucccucgacuacgccuggaagaccaccgccauggcccugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggcgaucggcaucgugagcauccugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggccguguccggcguguaccccaugagcauccccgcgacccuguuccucugguacuucuggcagaagaagaagcagcgguccgggguccugugggacacccccagcccgcccgagguggagcgcgccgugcuggacgacggcaucuaccggauccugcagcgcggccuccuggggcggucccaggucggcguggggguguuccaggacggcgucuuccacaccauguggcacgugacgcgcggggccgugcugauguaccagggcaagcggcucgagcccagcugggccuccgucaagaaggaccugaucagcuacggcgggggcuggcgcuuccagggguccuggaacaccggcgaggagguccaggugaucgccgucgagcccgggaagaacccgaagaacgugcagaccacccccggcacguucaagacccccgagggcgaggugggggcgaucgcccuggacuucaagcccggcaccagcggguccccgaucgucaaccgggagggcaagaucgugggccucuacgggaacggcguggucaccacgagcgggaccuacguguccgccaucgcccaggccaaggcgagccaggagggcccccugcccgagaucgaggacgagguguucaagaagcgcaaccugaccaucauggaccuccacccggggagcggcaagacccggcgcuaccugcccgccaucguccgggaggccaucaagcgcaagcugcggacgcucauccuggcccccacccgcgugguggcguccgagauggccgaggcccugaagggcaugcccauccgcuaccagaccaccgccgucaagagcgagcacacggggcgggagaucguggaccucaugugccacgccaccuucaccaugcgccugcuguccccggugcggguccccaacuacaacaugaucaucauggacgaggcgcacuucaccgaccccgccagcaucgccgcccgcggcuacaucuccacgcggguggggaugggcgaggccgcggccaucuucaugaccgccacgccgcccgggagcguggaggccuucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgcgaacugccuccgcaagaacggcaagcgggucauccagcugagccgcaagaccuucgacaccgaguaccagaagaccaagaacaacgacugggacuacguggugacgaccgacaucuccgagaugggggccaacuuccgggccgaccgcgucaucgacccccggcgcugccugaagcccgugauccucaaggacggccccgagcgggugauccuggccgggccgaugcccgucaccguggcgagcgccgcccagcgccggggccgcaucggccggaaccagaacaaggagggggaccaguacguguacaugggccagccccugaacaacgacgaggaccacgcccacuggaccgaggccaagaugcuccuggacaacaucaacacgcccgaggggaucaucccggcgcuguucgagcccgagcgcgagaaguccgccgccaucgacggcgaguaccgccuccgcggggaggcccgcaagaccuucgucgagcugaugcggcgcggcgaccugcccguguggcucagcuacaaggucgccuccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcgcggaccuacuccgacccgcuggcccugcgcgaguucaaggaguucgccgccgggcggcgcagcgucagcggcgaccucauccuggagaucggcaagcugccccagcaccucacccugcgggcccagaacgcgcuggacaaccucgugaugcugcacaacuccgagcagggcgggaaggccuaccgccacgccauggaggagcugcccgacacgaucgagacccucaugcugcuggcccucaucgcggugcugaccgggggcgucacccuguucuuccucagcgggaagggccugggcaagacguccaucgggcugcucugcgugaccgccagcuccgcccugcuguggauggccagcguggagccccacuggaucgccgcguccaucauccucgaguucuuccugaugguccugcucaucccggagcccgaccggcagcgcacgccccaggacaaccagcuggccuacguggugaucggccuccucuucaugauccugaccgucgccgccaacgagauggggcugcucgagacgaccaagaaggaccugggcaucgggcacguggccgcggagaaccaccagcacgccaccaugcuggacguggaccuccggccggccagcgccuggacccuguacgccgucgcgacgaccgugaucacccccaugaugcgccacaccaucgagaacacgaccgccaacaucucccugaccgccaucgccaaccaggccgcgauccucaugggccuggacaagggcuggcccaucagcaagauggacaucggggugccccugcucgcccugggcugcuacucccaggucaacccgcugacccucacggccgccgugcugaugcugguggcgcacuacgccaucaucgggcccggccuccaggccaaggccacccgggaggcccagaagcgcaccgcggccgggaucaugaagaaccccaccgucgacggcaucguggccaucgaccuggaccccguggucuacgacgccaaguucgagaagcagcugggccagaucaugcuccugauccugugcacgagccagauccuccugaugcgcaccaccugggcccugugcgaguccaucacccucgcgacggggccgcugaccacccugugggagggcagccccgggaaguucuggaacaccacgaucgccguguccauggccaacaucuuccggggcagcuaccucgccggcgccgggcuggcguucucccugaugaagucccucggcgggggccgccgggggaccggcgcccagggcgagacccugggggagaaguggaagcgccagcugaaccagcucuccaagagcgaguucaacaccuacaagcggagcggcaucauggagguggaccgcuccgaggccaaggaggggcugaagcggggcgagacgaccaagcacgccgucagccgcgggaccgcgaagcugcggugguucguggagcgcaaccuggugaagcccgagggcaaggucaucgaccucggcugcgggcggggcgggugguccuacuacugcgccggccugaagaaggugaccgaggugaagggguacaccaagggcggccccgggcacgaggagccgauccccauggccacguacggcuggacccuggucaagcuccacagcgggaaggacguguucuucaugccgcccgagaagugcgacacccugcugugcgacaucggcgaguccagcccgaaccccaccaucgaggaggggcgcacgcuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacccacgagauguacugggugagcugcggcaccgggaacaucguguccgccgucaacaugacgagccgcaugcugcugaaccgguucaccauggcccaccgcaagcccaccuucgagcgcgacguggaccucggcgcgggcacccggcacguggccgucgagcccgagguggccaaccuggacaucaucgggcagcgcaucgagaacaucaagaacgagcacaaguccacguggcacuacgacgaggacaacccguacaagaccugggccuaccacggcagcuacgaggugaagcccuccgggagcgccuccagcauggucaacggcguggugcggcugcucaccaagcccugggacgucauccccauggugacccagaucgcgaugacggacaccaccccguucgggcagcagcgcgucuucaaggagaagguggacacccggacgccccgcgccaagcggggcaccacccagaucauggaggugaccgccaaguggcuguggggcuuccugucccgcaacaagaagccccggaucugcacgcgcgaggaguucacccggaagguccgcagcaacgccgccaucggggcgguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgccgacgacaccgcggggugggacacgcggaucaccgaggacgaccugcagaacgaggccaagaucaccgacaucauggagcccgagcacgcccugcucgccaccagcaucuucaagcugacguaccagaacaagguggugcgcguccagcgccccgccaagaacggcaccgugauggacgugaucucccggcgcgaccagcgggggagcggccaggucggcaccuacgggcugaacaccuucacgaacauggaggugcagcucauccgccagauggaguccgagggcaucuuccugcccagcgagcuggagaccccgaaccucgcggagcgggugcuggacuggcuggagaagcacggggccgagcgccucaagcggauggccaucuccggcgacgacugcgucgugaagcccaucgacgaccgcuucgccaccgcccugaccgcgcugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagaccgccugccucggcaagagcuacgcccagauguggcagcugauguacuuccaccggcgcgaccugcggcucgcggccaacgccaucugcuccgccgugcccgucgacugggugcccacgagccgcaccaccuggagcauccacgcgcaccaccaguggaugaccacggaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgcgccaccugggccacgaacauccaggucgccaucaaccaggugcggcgccugaucgggaacgagaacuaccucgacuacaugaccuccaugaagcgguucaagaacgagagcgaccccgagggcgcgcugugguga

SEQ ID NO: 8088 - RNA, 9879 nt, Artificial Sequence
  derived and/or modified CDS sequence (opt1) from DENV-1__GQ868520__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacccucacgauccugcugaaggccacccuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccaugcccggcacguucaagacccccgagggcgaggucggggccaucgcccuggacuucaagcccggcaccagcggguccccgaucgugaaccgggagggcaagaucgugggccuguacgggaacggcgucgugaccacgagcgggaccuacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccauggugcgggaggccaucaagcgcaagcugcggacgcugauccucgcgcccacccgcguggucgccuccgagauggccgaggcccugaagggcaugcccauccgcuaccagaccaccgccgucaagagcgagcacacggggcgggagaucguggaccugaugugccacgcgaccuucaccaugcgccuccuguccccgguccgggugcccaacuacaacaugaucaucauggacgaggcccacuucaccgaccccgccagcaucgccgcccgcggcuacaucuccacgcggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucaccgacuuccccggcaagacggugugguucguccccagcaucaaguccgggaacgacaucgccaacugccugcgcaagaacggcaagcgggugauccagcucagccgcaagaccuucgacaccgaguaccagaagaccaagaacaacgacugggacuacguggucacgaccgacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacacgaucgagacccugaugcuccuggcgcugaucgccguccucaccgggggcgugacccuguucuuccugagcgggaagggccucggcaagacguccaucgggcugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagacgaccaagaaggaccucggcaucgggcacguggcggccgagaaccaccagcacgccaccaugcuggacgucgaccugcggccggccagcgccuggacccucuacgcgguggccacgaccgugaucacccccaugaugcgccacaccaucgagaacacgaccgccaacaucucccugaccgccaucgccaaccaggcggccauccugaugggccucgacaagggcuggcccaucagcaagauggacaucggggucccccugcuggcccucggcugcuacucccaggugaacccgcugacccugacggccgcggugcucaugcuggucgcccacuacgccaucaucgggcccggccugcaggccaaggccacccgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacggggccgcucaccacccugugggagggcagccccgggaaguucuggaacaccacgaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagacgaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccacguacggcuggaaccuggugaagcugcacagcgggaaggacguguucuucaugccgcccgagaagugcgacacccuccugugcgacaucggcgaguccagcccgaaccccaccaucgaggaggggcgcacccugcggguccucaagaugguggagcccuggcugcgcggcaaccaguucugcaucaagauccugaaccccuacaugccguccguggucgagacgcucgagcagaugcagcggaagcacggcgggaugcuggugcgcaacccccugagccggaacuccacccacgagauguacugggugagcugcggcaccgggaacaucgucuccgccgugaacaugaccagccgcaugcuccugaaccgguucacgauggcgcaccgcaagcccaccuacgagcgcgacguggaccugggcgccggcacccggcacgucgccguggagcccgagguggccaaccucgacaucaucgggcagcgcaucgagaacaucaagaacgagcacaaguccaccuggcacuacgacgaggacaacccguacaagacgugggccuaccacggcagcuacgaggucaagcccuccgggagcgcguccagcauggugaacggcgugguccggcugcugaccaagcccugggacgugauccccauggucacccagaucgccaugaccgacacgaccccguucgggcagcagcgcguguucaaggagaagguggacacccggacgccccgggccaagcggggcacgacccagaucauggaggucaccgccaaguggcucuggggcuuccugucccgcaacaagaagccccggaucugcacccgcgaggaguucacgcggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggugguccgcgugcagcgccccgcgaagaacggcacggugauggacgucaucucccggcgcgaccagcgggggagcggccaggugggcaccuacgggcugaacaccuucaccaacauggaggugcagcugauccgccagauggaguccgagggcaucuuccuccccagcgagcuggagacgccgaaccuggccgagcggguccucgacuggcuggagaagcacggggccgagcgccugaagcggauggccaucuccggcgacgacugcguggugaagcccaucgacgaccgcuucgccaccgcgcucaccgcccugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcgguccccguggacugggugcccaccagccgcacgaccuggagcauccacgcccaccaccaguggaugaccaccgaggacaugcucuccgucuggaaccggguguggaucgaggagaacccguggauggaggacaagacgcacgugagcuccugggaggagguccccuaccuggggaagcgcgaggaccaguggugcggcagccugaucggccucaccgcccgcgccaccugggccaccaacauccagguggcgaucaaccaggugcggcgccugaucgggaacgagaacuaccuggacuacaugacguccaugaagcgguucaagaacgagagcgaccccgagggcgcccucugguga

SEQ ID NO: 8089 - RNA, 9879 nt, Artificial Sequence
  derived and/or modified CDS sequence (opt1) from DENV-1__GQ868522__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccaugcccggcaccuucaagacgcccgagggcgaggucggggccaucgcccuggacuucaagcccggcaccagcggguccccgaucgugaaccgggagggcaagaucgugggccuguacgggaacggcgucgugaccaccagcgggacguacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccauggugcgggaggccaucaagcgcaagcugcggacccugauccucgcgcccacgcgcguggucgccuccgagauggccgaggcccugaagggcaugcccauccgcuaccagaccaccgccgucaagagcgagcacaccgggcgggagaucguggaccugaugugccacgcgacguucaccaugcgccuccuguccccgguccgggugcccaacuacaacaugaucaucauggacgaggcccacuucaccgaccccgccagcaucgccgcccgcggcuacaucuccacccggguggggaugggcgaggcggccgccaucuucaugacggccacgccgcccgggagcgucgaggccuucccccaguccaacgcggugauccaggacgaggagcgcgacauccccgagcggagcuggaacuccggcuacgacuggaucaccgacuuccccggcaagaccgugugguucguccccagcaucaaguccgggaacgacaucgccaacugccugcgcaagaacggcaagcgggugauccagcucagccgcaagacguucgacaccgaguaccagaagaccaagaacaacgacugggacuacguggucaccacggacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagacguucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacgcugaugcuccuggcgcugaucgccguccucaccgggggcgugacccuguucuuccugagcgggaagggccucggcaagaccuccaucgggcugcugugcgugacggccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagaccacgaagaaggaccucggcaucgggcacguggcggccgagaaccaccagcacgccaccaugcuggacgucgaccugcggccggccagcgccuggacccucuacgcgguggccaccacggugaucacccccaugaugcgccacaccaucgagaacaccacggccaacaucucccugaccgccaucgccaaccaggcggccauccugaugggccucgacaagggcuggcccaucagcaagauggacaucggggucccccugcuggcccucggcugcuacucccaggugaacccgcugacccugaccgccgcggugcucaugcuggucgcccacuacgccaucaucgggcccggccugcaggccaaggccacgcgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcaccagccagauccugcucaugcgcacgaccugggcgcugugcgaguccaucacccuggccaccgggccgcucacgacccugugggagggcagccccgggaaguucuggaacaccaccaucgccguguccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagaccacgaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccaccuacggcuggaaccuggugaagcugcacagcgggaaggacguguucuucaugccgcccgagaagugcgacacgcuccugugcgacaucggcgaguccagcccgaaccccaccaucgaggaggggcgcacccugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacgcacgagauguacugggugagcugcggcaccgggaacaucgucuccgccgugaacaugaccagccgcaugcuccugaaccgguucaccauggcgcaccgcaagcccacguacgagcgcgacguggaccugggcgccggcacccggcacgucgccguggagcccgagguggccaaccucgacaucaucgggcagcgcaucgagaacaucaagaacgagcacaaguccaccuggcacuacgacgaggacaacccguacaagaccugggccuaccacggcagcuacgaggucaagcccuccgggagcgcguccagcauggugaacggcgugguccggcugcugacgaagcccugggacgugauccccauggucacccagaucgccaugaccgacaccacgccguucgggcagcagcgcguguucaaggagaagguggacacccggacgccccgggccaagcggggcaccacgcagaucauggaggucaccgccaaguggcucuggggcuuccugucccgcaacaagaagccccggaucugcacccgcgaggaguucacccggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgacgugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucaccgaggacgaccuccagaacgaggccaagaucacggagaucauggagcccgagcacgcccugcuggccaccagcaucuucaagcucaccuaccagaacaaggugguccgcgugcagcgccccgcgaagaacggcaccgugauggacgucaucucccggcgcgaccagcgggggagcggccaggugggcacguacgggcugaacaccuucaccaacauggaggugcagcugauccgccagauggaguccgagggcaucuuccuccccagcgagcuggagaccccgaaccuggccgagcggguccucgacuggcuggagaagcacggggccgagcgccugaagcggauggccaucuccggcgacgacugcguggugaagcccaucgacgaccgcuucgccacggcgcucaccgcccugaacgacauggggaagguccggaaggacaucccccagugggagcccagcaagggcuggaacgacuggcagcaggccccguucugcucccaccacuuccaccagcugaucaugaaggacggccgcgagaucguggugcccugccggaaccaggacgagcucgucgggcgcgcccgggugagccagggcgccggguggucccugcgcgagaccgcgugccugggcaagagcuacgcccagauguggcagcucauguacuuccaccggcgcgaccugcggcuggccgccaacgcgaucugcuccgccgugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucacggcccgcgccaccugggcgaccaacauccaggucgccaucaaccaggugcggcgccugaucgggaacgagaacuaccuggacuacaugaccuccaugaagcgguucaagaacgagagcgaccccgagggcgcccucugguga

SEQ ID NO: 8090 - RNA, 9879 nt, Artificial Sequence
  derived and/or modified CDS sequence (opt1) from DENV-1__HQ166036__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacccucacgauccugcugaaggccacccuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccggggguccuggaacaccggcgaggaggugcaggucaucgcgguggagcccgggaagaacccgaagaacgugcagaccacgcccggcaccuucaagacccccgagggcgaggucggggccaucgcccuggacuucaagcccggcaccagcggguccccgaucgugaaccgcgagggcaagaucgugggccuguacgggaacggcgucgugacgaccagcgggaccuacguguccgccaucgcccaggcgaaggccagccaggagggcccccuccccgagaucgaggacgaggucuucaagaagcggaaccugaccaucauggaccugcacccggggagcggcaagacgcgccgguaccuccccgccaucgugcgcgaggccaucaagcggaagcugcgcacccugauccucgcgcccacccgcguggucgccuccgagauggccgaggcccugaagggcaugcccauccgguaccagaccacggccgucaagagcgagcacaccgggcgcgagaucguggaccugaugugccacgcgaccuucaccaugcggcuccuguccccgguccgcgugcccaacuacaacaugaucaucauggacgaggcccacuucacggaccccgccagcaucgccgcccggggcuacaucuccacccgcguggggaugggcgaggcggccgccaucuucaugaccgccacgccgcccgggagcgucgaggccuucccccaguccaacgcggugauccaggacgaggagcgggacauccccgagcgcagcuggaacuccggcuacgacuggaucacggacuuccccggcaagaccgugugguucguccccagcaucaaguccgggaacgacaucgccaacugccugcggaagaacggcaagcgcgugauccagcucagccggaagaccuucgacaccgaguaccagaagacgaagaacaacgacugggacuacguggucaccaccgacaucuccgagaugggggccaacuuccgcgccgaccgggugaucgacccccgccggugccugaagcccgugauccugaaggacggccccgagcgcgucauccucgcggggccgaugcccgugaccguggccagcgccgcccagcggcgcggccggaucggccgcaaccagaacaaggagggggaccaguacgucuacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccggcugcgcggggaggcccggaagaccuucguggagcucaugcgccggggcgaccugcccgucuggcugagcuacaagguggcguccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcaccuacuccgacccgcucgcccugcgggaguucaaggaguucgccgccgggcgccggagcgugagcggcgaccugauccucgagaucggcaagcugccccagcaccugacgucccgcgcgcagaacgcccucgacaaccuggugaugcugcacaacagcgagcagggcgggaaggccuaccggcacgccauggaggagcuccccgacaccaucgagacccugaugcugcucgcgcugaucgccguccugaccgggggcgugacccucuucuuccuguccgggaagggccugggcaagaccagcaucgggcuccugugcgugaccgccuccagcgcccugcucuggauggccuccgucgagccccacuggaucgcggccagcaucauccuggaguucuuccugauggugcuccugaucccggagcccgaccgccagcggacgccccaggacaaccagcuggccuacguggucaucggccuccuguucaugauccugacgguggccgccaacgagauggggcuccuggagaccaccaagaaggaccugggcaucgggcacguggcggccgagaaccaccagcacgccaccaugcucgacgucgaccugcgcccggccuccgccuggacgcuguacgcgguggccaccaccgugaucacccccaugaugcggcacacgaucgagaacaccaccgccaacaucagccucaccgccaucgccaaccaggcggccauccugaugggccuggacaagggcuggcccaucuccaagauggacaucggggucccccuccuggcccugggcugcuacagccaggugaacccgcucacgcugaccgccgcggugcugaugcucgucgcccacuacgccaucaucgggcccggccugcaggccaaggccacccgcgaggcgcagaagcgcaccgccgccgggaucaugaagaaccccacgguggacggcaucguggccaucgaccuggaccccgucguguacgacgccaaguucgagaagcagcucggccagaucaugcugcugauccucugcaccucccagauccugcugaugcggaccaccugggcgcucugcgagagcaucacgcuggccaccgggccgcugaccacccucugggagggcucccccgggaaguucuggaacacgaccaucgccgugagcauggccaacaucuuccgcggcuccuaccuggccggcgcggggcuggccuucagccucaugaagucccugggcgggggccggcgcgggaccggcgcccagggcgagacccugggggagaaguggaagcggcagcucaaccagcugagcaagagcgaguucaacacguacaagcgcuccggcaucauggaggucgaccggagcgaggccaaggaggggcugaagcgcggcgagaccaccaagcacgcggugucccgggggaccgccaagcuccgcugguucguggagcggaaccuggucaagcccgagggcaaggugaucgaccugggcugcgggcgcggcggguggagcuacuacugcgccggccugaagaaggugaccgaggucaagggguacacgaagggcggccccgggcacgaggagccgauccccauggccaccuacggcuggaaccucgugaagcugcacuccgggaaggacguguucuucaugccgcccgagaagugcgacacccugcucugcgacaucggcgagagcuccccgaaccccaccaucgaggaggggcggacgcugcgcguccugaagaugguggagcccuggcuccggggcaaccaguucugcaucaagauccugaaccccuacaugccgagcguggucgagacccuggagcagaugcagcgcaagcacggcgggaugcucgugcggaacccccugucccgcaacagcacccacgagauguacuggguguccugcggcaccgggaacaucgucagcgccgugaacaugacgucccggaugcugcucaaccgcuucaccauggcgcaccgcaagcccaccuacgagcgggacguggaccugggcgccggcacccgccacgucgccguggagcccgagguggccaaccuggacaucaucgggcagcggaucgagaacaucaagaacgagcacaagagcacguggcacuacgacgaggacaacccguacaagaccugggccuaccacggcuccuacgaggucaagcccagcggguccgcgagcuccauggugaacggcgugguccgccuccugaccaagcccugggacgugauccccauggucacccagaucgccaugacggacaccaccccguucgggcagcagcggguguucaaggagaagguggacacccgcacgccccgggccaagcgcggcaccacccagaucauggaggucaccgccaaguggcuguggggcuuccucagccggaacaagaagccccgcaucugcacgcgggaggaguucacccgcaaggugcggagcaacgccgcgaucggggccguguucgucgacgagaaccaguggaacuccgccaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagaucccgggcggcaacauguacgcggacgacaccgccgggugggacacgcgcaucaccgaggacgaccugcagaacgaggccaagaucaccgagaucauggagcccgagcacgcccuccuggccaccuccaucuucaagcugacguaccagaacaaggugguccgcgugcagcggcccgcgaagaacggcaccgugauggacgucaucagccgccgggaccagcgcggguccggccaggugggcaccuacgggcucaacaccuucacgaacauggaggugcagcugauccggcagauggagagcgagggcaucuuccugcccuccgagcucgagaccccgaaccuggccgagcgcguccuggacuggcucgagaagcacggggccgagcggcugaagcgcauggccaucagcggcgacgacugcguggugaagcccaucgacgaccgguucgccaccgcgcugaccgcccucaacgacauggggaagguccgcaaggacaucccccagugggagcccuccaagggcuggaacgacuggcagcaggucccguucugcagccaccacuuccaccagcugaucaugaaggacggccgggagaucgugguccccugccgcaaccaggacgagcugguggggcgggcccgcgugucccagggcgccggguggagccuccgggagaccgccugccugggcaaguccuacgcgcagauguggcagcugauguacuuccaccgccgggaccuccgccuggccgccaacgccaucugcagcgcgguccccguggacugggugcccacgagccggaccaccugguccauccacgcccaccaccaguggaugaccacggaggacaugcugagcgucuggaaccgcguguggaucgaggagaacccguggauggaggacaagacccacguguccagcugggaggagguccccuaccucgggaagcgcgaggaccaguggugcggcucccugaucggccugaccgcccgggccaccugggccacgaacauccagguggcgaucaaccaggugcgccggcucaucgggaacgagaacuaccuggacuacaugaccagcaugaagcgcuucaagaacgaguccgaccccgagggcgcccugugguga

SEQ ID NO: 8091 - RNA, 9879 nt, Artificial Sequence
  derived and/or modified CDS sequence (opt1) from DENV-1__GU131981__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucauggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccgucgggaagcuggugcaccagguguucggcaccgccuacgggguccuguucagcggcguguccuggacgaugaagaucgggaucggcauccuccugaccuggcugggccucaacagccgcuccaccagccuguccaugaccugcaucgccguggggauggucacgcuguaccucggcgugauggugcaggccgacagcgggugcgucaucaacuggaagggccgcgagcugaagugcggguccggcaucuucgugaccaacgaggugcacaccuggaccgagcaguacaaguuccaggccgacagcccgaagcggcugagcgcggccaucggcaaggccugggaggagggggucugcggcauccgcuccgccacccggcucgagaacaucauguggaagcagaucagcaacgagcugaaccacauccugcucgagaacgacaugaaguucacggugguggucggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggauccugugcgccagcaucaugaucgaggaggugaugcggucccgcuggagccggaagaugcucaugacgggcacccuggccguguuccugcuccuggucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcacgagccacaacauccugguggaggugcaggacgacgggaccaugaagaucaaggacgaggagcgcgacgacacccucaccauccugcugaaggccacgcuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacgcgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccaugcccggcaccuucaagacgcccgagggcgaggugggggccaucgcccuggacuucaagcccggcaccagcggguccccgaucgucaaccgggagggcaagaucgugggccuguacgggaacggcguggucaccaccagcgggacguacguguccgccaucgcccaggcgaaggccagccaggagggcccccuccccgagaucgaggacgagguguucaagaagcgcaaccugaccaucauggaccugcacccggggagcggcaagacccggcgcuaccuccccgccaugguccgggaggccaucaagcgcaagcugcggacccugauccucgcgcccacgcgcgugguggccuccgagauggccgaggcccugaagggcaugcccauccgcuaccagaccaccgccgucaagagcgagcacaccgggcgggagaucguggaccugaugugccacgcgacguucaccaugcgccuccuguccccggugcggguccccaacuacaacaugaucaucauggacgaggcccacuucaccgaccccgccagcaucgccgcccgcggcuacaucuccacccggguggggaugggcgaggcggccgccaucuucaugacggccacgccgcccgggagcguggaggccuucccccaguccaacgcggucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagacguucgacaccgaguaccagaagaccaagaacaacgacugggacuacguggugaccacggacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagacguucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacgcugaugcuccuggcgcugaucgccgugcucaccgggggcgucacccuguucuuccugagcgggaagggccucggcaagaccuccaucgggcugcugugcgugacggccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccacgaagaaggaccucggcaucgggcacguggcggccgagaaccaccagcacgccaccaugcuggacguggaccugcggccggccagcgccuggacccucuacgcggucgccaccacggugaucacccccaugaugcgccacaccaucgagaacaccacggccaacaucucccugaccgccaucgccaaccaggcggccauccugaugggccucgacaagggcuggcccaucagcaagauggacaucggggugccccugcuggcccucggcugcuacucccaggucaacccgcugacccugaccgccgcggugcucaugcugguggcccacuacgccaucaucgggcccggccugcaggccaaggccacgcgggaggcgcagaagcgcaccgccgccgggaucaugaagaaccccaccgucgacggcaucguggccaucgaccucgaccccguggucuacgacgccaaguucgagaagcagcugggccagaucaugcugcucauccugugcaccagccagauccugcucaugcgcacgaccugggcgcugugcgaguccaucacccuggccaccgggccgcucacgacccugugggagggcagccccgggaaguucuggaacaccaccaucgccguguccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggagguggaccgcuccgaggccaaggaggggcucaagcggggcgagaccacgaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacaccaagggcggccccgggcacgaggagccgauccccauggccaccuacggcuggaaccuggucaagcugcacagcgggaaggacguguucuucaugccgcccgagaagugcgacacgcuccugugcgacaucggcgaguccagcccgaaccccaccaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacgcacgagauguacugggugagcugcggcaccgggaacaucguguccgccgucaacaugaccagccgcaugcuccugaaccgguucaccauggcgcaccgcaagcccacguacgagcgcgacguggaccugggcgccggcacccggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggucaacggcguggugcggcugcugacgaagcccugggacgucauccccauggugacccagaucgccaugaccgacaccacgccguucgggcagcagcgcgucuucaaggagaagguggacacccggacgccccgggccaagcggggcaccacgcagaucauggaggugaccgccaaguggcucuggggcuuccugucccgcaacaagaagccccggaucugcacccgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgacgugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacccggaucaccgaggacgaccuccagaacgaggccaagaucacggagaucauggagcccgagcacgcccugcuggccaccagcaucuucaagcucaccuaccagaacaagguggugcgcguccagcgccccgcgaagaacggcaccgugauggacgugaucucccggcgcgaccagcgggggagcggccaggucggcacguacgggcugaacaccuucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccacggcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucacggcccgcgccaccugggccaccaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8092 - RNA, 9879 nt, Artificial Sequence
  derived and/or modified CDS sequence (opt1) from DENV-1__GQ868529__SS-prME
agcgugaccaugcugcucaugcugcugcccaccgcccucgccuuccaccugaccacccggggcggggagccccacaugaucgugagcaagcaggagcggggcaagagccuccucuucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcgauccugcgcaagcucugcaucgaggccaagaucagcaacaccaccacggacucccggugcccgacccagggcgaggccacccugguggaggagcaggacgccaacuucgugugccgccggaccuucgucgaccgcggcugggggaacggcugcgggcuguucggcaaggggagccuccugacgugcgccaaguucaagugcgugaccaagcuggagggcaagaccgugcaguacgagaaccucaaguacuccgucaucgugaccgugcacacgggcgaccagcaccaggucgggaacgagaccaccgagcacggcaccaucgcgaccaucacgccccaggcccccaccagcgagauccagcugaccgacuacggggcccugacccucgacugcagcccccggacgggccuggacuucaacgagauggugcugcucaccaugaaggagaaguccuggcugguccacaagcagugguuccuggaccucccgcugcccuggaccuccggggccagcaccagccaggagacguggaaccgccaggaccugcucgugaccuucaagaccgcccacgcgaagaagcaggagguggucgugcugggcucccaggagggcgccaugcacaccgcccugacgggggccaccgagauccagaccagcggcaccacgaccaucuucgccgggcaccucaagugccggcugaagauggacaagcugacccucaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccugaucaccgccaacccgaucgugaccgacaaggagaagcccgucaacaucgagacggagccgcccuucggggagagcuacaucguggugggcgccggcgagaaggcgcucaagcuguccugguucaagaaggggagcuccaucggcaagauguucgaggccaccgcccgcggggcccgccggauggccauccugggcgacaccgcgugggacuucgggagcaucggcggcgucuucaccuccguggggaagcucgugcaccaggucuucggcacggccuacggggugcuguucagcggcguguccuggaccaugaagaucgggaucggcauccugcucaccuggcugggccugaacagccgcuccaccagccucuccaugacgugcaucgccgucgggauggugacccuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcugcgcgacuccuacacccagaugugcgaccaccggcucaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccugugguccaacggcgugcucgagagcgagaugaucauccccaagaucuacgggggcccgaucucccagcacaacuaccggcccggguacuucacgcagaucgccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgccagcaucaugaucgaggaggugaugcggucccgcuggagccggaagaugcugaugacgggcacccucgccgucuuccugcugcucgugauggggcagcugaccuggaacgaccugauccgccucugcaucauggugggcgcgaacgccuccgaccgcauggggaugggcaccacguaccuggcccugauggccaccuucaagaugcggccgauguucgccgucggccuccuguuccgccggcugaccagccgcgaggugcuccugcugaccaucgggcucucccugguggcgagcgucgagcugcccaacucccucgaggagcugggcgacgggcuggccaugggcaucaugaugcucaagcugcugacggaguuccagccccaccagcucuggaccacccugcugagccucaccuucaucaagacgacccugucccuggacuacgccuggaagaccaccgccauggcgcucagcaucgugucccuguucccccugugccucagcacgaccucccagaagaccaccuggcugccgguccugcucggcagcuucgggugcaagccccugaccauguuccugaucacggagaacaagaucuggggccggaaguccuggccccucaacgaggggaucauggccaucggcaucgugagcauccugcuguccagccuccugaagaacgacgugccccuggccgggccgcucaucgccggcggcaugcugaucgccugcuacgucaucagcggguccagcgcggaccugucccucgagaaggccgccgaggugagcugggagcaggaggccgagcacuccggcaccagccacaacauccugguggagguccaggacgacgggaccaugaagaucaaggacgaggagcgcgacgacacccugacgauccuccugaaggccacccugcucgcgguguccggcguguaccccaugagcauccccgccacccuguucgucugguacuucuggcagaagaagaagcagcgguccggggugcugugggacacccccagcccgcccgagguggagcgcgccguccucgacgacggcaucuaccggauccugcagcgcggccugcuggggcggucccaggugggcgugggggucuuccaggacggcguguuccacacgauguggcacgugacccgcggggccguccucauguaccagggcaagcggcuggagcccagcugggccuccgugaagaaggaccugaucagcuacggcgggggcuggcgcuuccagggguccuggaacaccggcgaggaggugcaggucaucgcgguggagcccgggaagaacccgaagaacgugcagaccacgcccggcaccuucaagacccccgagggcgaggucggggccaucgcccucgacuucaagcccggcaccagcggguccccgaucgugaaccgggagggcaagaucgugggccuguacgggaacggcgucgugacgaccagcgggaccuacguguccgccaucgcccaggcgaaggccagccaggagggcccccugcccgagaucgaggacgaggucuucaagaagcgcaaccucaccaucauggaccugcacccggggagcggcaagacgcggcgcuaccugcccgccauggugcgggaggccaucaagcgcaagcuccggacccugauccuggcgcccacccgcguggucgccuccgagauggccgaggcccucaagggcaugcccauccgcuaccagaccacggccgucaagagcgagcacaccgggcgggagaucguggaccugaugugccacgcgaccuucaccaugcgccugcucuccccgguccgggugcccaacuacaacaugaucaucauggacgaggcccacuucacggaccccgccagcaucgccgcccgcggcuacaucuccacccggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucacggacuuccccggcaagaccgugugguucguccccagcaucaaguccgggaacgacaucgccaacugccugcgcaagaacggcaagcgggugauccagcugagccgcaagaccuucgacaccgaguaccagaagacgaagaacaacgacugggacuacguggucaccaccgacaucuccgagaugggggccaacuuccgggccgaccgcgugaucgacccccggcgcugccucaagcccgugauccugaaggacggccccgagcgggucauccuggcggggccgaugcccgugaccguggccagcgccgcccagcgccggggccgcaucggccggaaccagaacaaggagggggaccaguacgucuacaugggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccgccugcgcggggaggcccgcaagaccuucguggagcugaugcggcgcggcgaccuccccgucuggcugagcuacaagguggcguccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggaccuacuccgacccgcuggcccuccgcgaguucaaggaguucgccgccgggcggcgcagcgugagcggcgaccugaugcuggagaucggcaagcucccccagcaccugacgcugcgggcgcagaacgcccucgacaaccuggugaugcugcacaacuccgagcagggcgggaaggccuaccgccacgccauggaggagcuccccgacaccaucgagacccugaugcugcucgcgcugaucgccguccugaccgggggcgugacccucuucuuccugagcgggaagggccugggcaagaccuccaucgggcuccugugcgugaccgccagcuccgcccugcucuggauggccagcgucgagccccacuggaucgcggccuccaucauccuggaguucuuccugauggugcuccugaucccggagcccgaccggcagcgcacgccccaggacaaccagcuggccuacguggucaucggccuccuguucaugauccugacgguggccgccaacgagauggggcuccuggagaccaccaagaaggaccugggcaucgggcacguggcggccgagaaccaccagcacgccaccaugcucgacgucgaccugcggccggccagcgccuggacgcuguacgcgguggccaccaccgugaucacccccaugaugcgccacacgaucgagaacaccaccgccaacaucucccucaccgccaucgccaaccaggcggccauccugaugggccuggacaagggcuggcccaucagcaagauggacaucggggucccccuccuggcccugggcugcuacucccaggugaacccgcucacgcugaccgccgcggugcugaugcucgucgcccacuacgccaucaucgggcccggccugcaggccaaggccacccgggaggcgcagaagcgcaccgccgccgggaucaugaagaaccccacgguggacggcaucguggccaucgaccuggaccccgucguguacgacgccaaguucgagaagcagcucggccagaucaugcugcugauccucugcaccagccagauccugcugaugcgcaccaccugggcgcucugcgaguccaucacgcuggccaccgggccgcugaccacccucugggagggcagccccgggaaguucuggaacacgaccaucgccguguccauggccaacaucuuccggggcagcuaccuggccggcgcggggcuggccuucucccucaugaagucccugggcgggggccgccgggggaccggcgcccagggcgagacccugggggagaaguggaagcgccagcucaaccagcuguccaagagcgaguucaacacguacaagcggagcggcaucauggaggucgaccgcuccgaggccaaggaggggcugaagcggggcgagaccaccaagcacgcggugagccgcgggaccgccaagcuccggugguucguggagcgcaaccuggucaagcccgagggcaaggugaucgaccugggcugcgggcggggcgggugguccuacuacugcgccggccugaagaaggugaccgaggucaagggguacacgaagggcggccucgggcacgaggaccccaucccgauggccaccuacggcuggaaccuggugaagcugcucgccgggaaggacguguucuucaugccgcccgagaagugcgacacccugcugugcgacaucggcgagagcucccccaacccgaccaucgaggaggggcgcacgcuccggguccugaagaugguggagcccuggcugcgcggcaaccaguucugcaucaagauccucaaccccuacaugcccagcguggucgagacccuggagcagaugcagcggaagcacggcgggaugcuggugcgcaacccgcucucccggaacagcacccacgagauguacuggguguccugcggcaccgggaacaucgucagcgcggugaacaugacgucccgcaugcugcugaaccgguucaccauggcccaccgcaagcccaccuacgagcgcgacguggaccucggcgccggcacccggcacgucgccguggagcccgagguggccaaccuggacaucaucgggcagcgcaucgagaacaucaagaacgagcacaagagcacguggcacuacgacgaggacaaccccuacaagaccugggcguaccacggcuccuacgaggucaagccgagcggguccgccagcuccauggugaacggcgugguccggcugcucaccaagcccugggacgugauccccauggucacccagaucgccaugacggacaccacccccuucgggcagcagcgcguguucaaggagaagguggacacccggacgccgcgcgccaagcggggcaccacccagaucauggaggucaccgccaaguggcuguggggcuuccugagccgcaacaagaagccccggaucugcacgcgcgaggaguucacccggaaggugcgcuccaacgcggccaucggggccguguucgucgacgagaaccaguggaacagcgccaaggaggcgguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcagccgggccaucugguacauguggcucggcgcccgcuuccuggaguucgaggcgcugggguucaugaacgaggaccacugguucucccgggagaacagccucuccggcguggagggggagggccugcacaagcugggguacauccuccgcgacaucagcaagauccccggcggcaacauguacgccgacgacaccgccgggugggacacgcggaucaccgaggacgaccugcagaacgaggccaagaucaccgagaucauggagccggagcacgcccugcucgcgaccuccaucuucaagcugacguaccagaacaaggugguccgcgugcagcgccccgccaagaacggcaccgugauggacgucaucagccggcgcgaccagcggggguccggccaggugggcaccuacgggcugaacaccuucacgaacauggaggugcagcucauccgccagauggagagcgagggcaucuuccugcccuccgagcuggagacccccaaccucgccgagcggguccuggacuggcuggagaagcacggggccgagcgccucaagcggauggccaucagcggcgacgacugcguggugaagccgaucgacgaccgcuucgcgaccgcccugaccgcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugucccagggcgccggguggagccugcgcgagaccgcgugccucggcaaguccuacgcccagauguggcagcugauguacuuccaccggcgcgaccugcggcucgccgccaacgcgaucugcagcgccguccccguggacugggugcccacgucccgcaccaccuggagcauccacgcccaccaccaguggaugaccacggaggacaugcugagcgucuggaaccggguguggaucgaggagaaccccuggauggaggacaagacccacguguccagcugggaggaggucccguaccuggggaagcgcgaggaccaguggugcggcucccucaucggccugaccgcccgcgccaccugggcgacgaacauccagguggccaucaaccaggugcggcgccugaucgggaacgagaacuaccucgacuacaugaccagcaugaagcgguucaagaacgaguccgaccccgagggcgcccugugguga

SEQ ID NO: 8093 - RNA, 9879 nt, Artificial Sequence
  derived and/or modified CDS sequence (opt1) from DENV-1__GQ868531__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggaggcccucgagcagaugcagcggaagcacggcgggaugcuggugcgcaacccccugagccggaacuccacccacgagauguacugggucagcugcggcaccgggaacaucguguccgccgugaacaugaccagccgcaugcuccugaaccgguucacgauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccaccuggcacuacgacgaggacaacccguacaagacgugggccuaccacggcagcuacgaggugaagcccuccgggagcgcguccagcauggugaacggcgucgugcggcugcugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggucgugcgcgugcagcgccccgcgaagaacggcacggucauggacgugaucucccggcgcgaccagcgggggagcggccaggugggcaccuacgggcugaacaccuucaccaacauggagguccagcugauccgccagauggaguccgagggcaucuuccuccccagcgagcuggagacgccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucuccagcgcggugcccguggacuggguccccaccagccgcacgaccugguccauccacgcccaccaccaguggaugaccaccgaggacaugcucagcguguggaaccggguguggaucgaggagaacccguggauggaggacaagacgcacgucuccagcugggaggaggugcccuaccuggggaagcgcgaggaccaguggugcggcucccugaucggccucaccgcccgcgccaccugggccaccaacauccagguggcgaucaaccagguccggcgccugaucgggaacgagaacuaccuggacuacaugacgagcaugaagcgguucaagaacgaguccgaccccgagggcgcccucugguga

SEQ ID NO: 8094 - RNA, 9879 nt, Artificial Sequence
  derived and/or modified CDS sequence (opt1) from DENV-1__GU131983__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggggagcucugcgaggacaccaugaccuacaagugcccccagaucaccgaggccgagcccgacgacguggacugcuggugcaacgccaccgacaccugggugaccuacgggaccugcagccagaccggggagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaucggcacgcuggccgucuuccugcuccuggugauggggcagcugaccuggaacgaccucauccgccugugcaucauggugggcgcgaacgccuccgaccgcauggggaugggcaccaccuaccuggcccucauggccacguucaagaugcggccgauguucgccgucggccugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucaccgaguuccagccccaccagcuguggacgacccugcucagccugaccuucaucaagaccacgcugucccucgacuacgccuggaagaccaccgccauggcgcugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcacgagccacaacauccugguggagguccaggacgacgggaccaugaagaucaaggacgaggagcgcgacgacacccucaccauccugcugaaggccacgcuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccacccccggcacguucaagacccccgagggcgaggucggggccaucgcccuggacuucaagcccggcaccagcggguccccgaucgugaaccgggagggcaagaucgugggccuguacgggaacggcgucgugaccacgagcgggaccuacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccaucgugcgggaggccaucaagcgcaagcugcggacgcugauccucgcgcccacccgcguggucgccuccgagauggccgaggcccugaagggcaugcccauccgcuaccagaccaccgccgucaagagcgagcacacggggcgggagaucguggaccugaugugccacgcgaccuucaccaugcgccuccuguccccgguccgggugcccaacuacaacaugaucaucauggacgaggcccacuucaccgaccccgccagcaucgccgcccgcggcuacaucuccacgcggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucaccgacuuccccggcaagacggugugguucguccccagcaucaaguccgggaacgacaucgccaacugccugcgcaagaacggcaagcgggugauccagcucagccgcaagaccuucgacaccgaguaccagaagaccaagaacaacgacugggacuacguggucacgaccgacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacacgaucgagacccugaugcuccuggcgcugaucgccguccucaccgggggcgugacccuguucuuccugagcgggaagggccucggcaagacguccaucgggcugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagacgaccaagaaggaccucggcaucgggcacguggcggccgagaaccaccagcacgccaccaugcuggacgucgaccugcggccggccagcgccuggacccucuacgcgguggccacgaccgugaucacccccaugaugcgccacaccaucgagaacacgaccgccaacaucucccugaccgccaucgccaaccaggcggccauccugaugggccucgacaagggcuggcccaucagcaagauggacaucggggucccccugcuggcccucggcugcuacucccaggugaacccgcugacccugacggccgcggugcucaugcuggucgcccacuacgccaucaucgggcccggccugcaggccaaggccacccgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacggggccgcucaccacccugugggagggcagccccgggaaguucuggaacaccacgaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagacgaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccacguacggcuggaaccuggugaagcugcacagcgggaaggacguguucuucaugccgcccgagaagugcgacacccuccugugcgacaucggcgaguccagcccgaaccccaccaucgaggaggggcgcacccugcggguccucaagaugguggagcccuggcugcgcggcaaccaguucugcaucaagauccugaaccccuacaugccguccguggucgagacgcucgagcagaugcagcggaagcacggcgggaugcuggugcgcaacccccugagccggaacuccacccacgagauguacugggugagcugcggcaccgggaacaucgucuccgccgugaacaugaccagccgcaugcuccugaaccgguucacgauggcgcaccgcaagcccaccuacgagcgcgacguggaccugggcgccggcacccggcacgucgccguggagcccgagguggccaaccucgacaucaucgggcagcgcaucgagaacaucaagaacgagcacaaguccaccuggcacuacgacgaggacaacccguacaagacgugggccuaccacggcagcuacgaggucaagcccuccgggagcgcguccagcauggugaacggcgugguccggcugcugaccaagcccugggacgugauccccauggucacccagaucgccaugaccgacacgaccccguucgggcagcagcgcguguucaaggagaagguggacacccggacgccccgggccaagcggggcacgacccagaucauggaggucaccgccaaguggcucuggggcuuccugucccgcaacaagaagccccggaucugcacccgcgaggaguucacgcggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggugguccgcgugcagcgccccgcgaagaacggcacggugauggacgucaucucccggcgcgaccagcgggggagcggccaggugggcaccuacgggcugaacaccuucaccaacauggaggugcagcugauccgccagauggaguccgaggagaucuuccuccccagcgagcuggagacgccgaaccuggccgagcggguccucgacuggcuggagaagcacggcgccgagcgccugaagcggauggccaucuccggggacgacugcguggugaagcccaucgacgaccgcuucgccaccgcgcucaccgcccugaacgacaugggcaagguccggaaggacaucccccagugggagcccagcaagggguggaacgacuggcagcaggucccguucugcucccaccacuuccaccagcugaucaugaaggacggccgcgagaucgugguccccugccggaaccaggacgagcucgugggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcgguccccguggacugggugcccaccagccgcacgaccuggagcauccacgcccaccaccaguggaugaccaccgaggacaugcucuccgucuggaaccggguguggaucgaggagaacccguggauggaggacaagacgcacgugagcuccugggaggagguccccuaccugggcaagcgcgaggaccaguggugcgggagccugaucggccucaccgcccgcgccaccugggccaccaacauccagguggcgaucaaccaggugcggcgccugaucggcaacgagaacuaccuggacuacaugacguccaugaagcgguucaagaacgagagcgaccccgagggggcccucugguga

SEQ ID NO: 8095 - RNA, 9879 nt, Artificial Sequence
  derived and/or modified CDS sequence (opt1) from DENV-1__GQ868532__SS-prME
agcgugaccaugcugcucaugcugcugcccaccgcccucgccuuccaccugaccacccggggcggggagccgcacaugaucgucagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccuggugauggggcagcugaccuggaacgaccucauccgccugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaucacccugcucagccugaccuucaucaagaccacgcugucccucgacuacgccuggaagaccaccgccauggcgcugagcaucgugucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcgggaacuccgcggaccucagccuggagaaggccgccgagguguccugggagcaggaggccgagcacagcggcacgucccacaacauccugguggagguccaggacgacgggaccaugaagaucaaggacgaggagcgcgacgacacccucaccauccugcugaaggccacgcuccuggcggugagcggcguguaccccauguccauccccgccacccuguucgucugguacuucuggcagaagaagaagcagcggagcggggugcucugggacacccccuccccgcccgagguggagcgcgccguccuggacgacggcaucuaccggauccugcagcgcggccugcucgggcggagccaggugggcgugggggucuuccaggacggcguguuccacaccauguggcacgugacgcgcggggccguccugauguaccagggcaagcggcuggagcccuccugggccagcgugaagaaggaccucaucuccuacggcgggggcuggcgcuuccaggggagcuggaacaccggcgaggaggugcaggucaucgcgguggagcccgggaagaacccgaagaacgugcagaccaugcccggcaccuucaagacgcccgagggcgaggucggggccaucgcccuggacuucaagcccggcaccuccgggagcccgaucgugaaccgggagggcaagaucgugggccuguacgggaacggcgucgugaccaccuccgggacguacgugagcgccaucgcccaggcgaaggccucccaggaggggccgccgcccgagaucgaggacgaggucuucaagaagcgcaaccucaccaucauggaccugcaccccgggagcggcaagacccggcgcuaccugcccgccauggugcgggaggccaucaagcgcaagcuccggacccugauccuggcgcccacgcgcguggucgccagcgagauggccgaggcccucaagggcaugcccauccgcuaccagaccaccgccgugaaguccgagcacaccgggcgggagaucguggaccugaugugccacgcgacguucaccaugcgccugcucagccccguccgggugcccaacuacaacaugaucaucauggacgaggcccacuucaccgaccccgccuccaucgccgcccgcggcuacaucagcacccggguggggaugggcgaggcggccgccaucuucaugacggccaccccgcccggguccgucgaggccuucccccagagcaacgcggugauccaggacgaggagcgcgacauccccgagcgguccuggaacagcggcuacgacuggaucaccgacuucccgggcaagaccgugugguucguccccuccaucaagagcgggaacgacaucgccaacugccugcgcaagaacggcaagcgggugauccagcugucccgcaagacguucgacaccgaguaccagaagaccaagaacaacgacugggacuacguggucaccacggacaucagcgagaugggggccaacuuccgggccgaccgcgugaucgacccccggcgcugccucaagcccgugauccugaaggacggcccggagcgggucauccuggcggggcccaugcccgugaccguggccuccgccgcccagcgccggggccgcaucggccggaaccagaacaaggagggggaccaguacgucuacaugggccagccccucaacaacgacgaggaccacgcccacuggaccgaggcgaagaugcugcuggacaacaucaacaccccggaggggaucauccccgcccucuucgagcccgagcgcgagaaguccgccgccaucgacggcgaguaccgccugcgcggggaggcccgcaagacguucguggagcugaugcggcgcggcgaccuccccgucuggcuguccuacaagguggcgagcgagggcuuccaguacuccgaccggcgcuggugcuucgacggggagcggaacaaccaggugcuggaggagaacauggacgucgagaucuggaccaaggagggcgagcgcaagaagcuccggccgcgcuggcuggacgcccggaccuacagcgacccccuggcccuccgcgaguucaaggaguucgccgccgggcggcgcuccgugagcggcgaccugauccuggagaucggcaagcucccccagcaccugacccugcgggcgcagaacgcccucgacaaccuggugaugcugcacaacagcgagcagggcgggaaggccuaccgccacgccauggaggagcuccccgacaccaucgagacgcugaugcugcucacccugaucgcgguccugaccgggggcgugacccucuucuuccuguccgggaagggccugggcaagacgagcaucgggcuccugugcgugaccgccuccagcgcccugcucuggauggccuccgucgagccgcacuggaucgccgcgagcaucauccuggaguucuuccugauggugcuccugauccccgagcccgaccggcagcgcaccccgcaggacaaccagcuggccuacguggucaucggccuccuguucaugauccugaccguggccgccaacgagauggggcuccuggagacgaccaagaaggaccugggcaucgggcacguggccgcggagaaccaccagcacgccaccaugcucgacgucgaccugcggcccgccuccgccuggacccuguacgccguggcgacgaccgugaucacccccaugaugcgccacaccaucgagaacacgaccgccaacaucagccucaccgccaucgccaaccaggccgcgauccugaugggccuggacaagggcuggcccaucuccaagauggacaucggggucccgcuccuggcccugggcugcuacagccaggugaacccccucacccugacggccgccgugcugaugcucgucgcgcacuacgccaucaucgggcccggccugcaggccaaggccacccgggaggcccagaagcgcaccgcggccgggaucaugaagaaccccaccguggacggcaucguggccaucgaccuggacccggucguguacgacgccaaguucgagaagcagcucggccagaucaugcugcugauccucugcacgucccagauccugcugaugcgcaccaccugggcccucugcgagagcaucacccuggcgacggggccccugaccacccucugggagggcucccccgggaaguucuggaacaccacgaucgccgugagcauggccaacaucuuccggggcuccuaccuggccggcgccgggcuggcguucagccucaugaagucccugggcgggggccgccgggggaccggcgcccagggcgagacccugggggagaaguggaagcgccagcucaaccagcugagcaaguccgaguucaacaccuacaagcggagcggcaucauggaggucgaccgcagcgaggccaaggaggggcugaagcggggcgagacgaccaagcacgccgugucccgcgggaccgcgaagcuccggugguucguggagcgcaaccuggucaagcccgagggcaaggugaucgaccugggcugcgggcggggcggguggagcuacuacugcgccggccugaagaaggugaccgaggucaagggguacaccaagggcggcccggggcacgaggagcccauccccauggccacguacggcuggaaccucgugaagcugcacuccgggaaggacguguucuucaugcccccggagaagugcgacacccugcucugcgacaucggcgagagcucccccaaccccaccaucgaggaggggcgcacccugcggguccugaagaugguggagcccuggcuccgcggcaaccaguucugcaucaagauccugaacccguacaugcccaacguggucgagacgcuggagcagaugcagcggaagcacggcgggaugcucgugcgcaacccccugagccggaacuccacccacgagauguacugggugagcugcggcaccgggaacaucgucuccgccgugaacaugaccagccgcaugcugcucaaccgguucacgauggcccaccgcaagcccaccuacgagcgcgacguggaccugggcgcgggcacccggcacgucgccguggagccggagguggccaaccuggacaucaucgggcagcgcaucgagaacaucaagaacgagcacaaguccaccuggcacuacgacgaggacaaccccuacaagacgugggccuaccacggcagcuacgaggucaagcccuccgggagcgccuccagcauggugaacggcgugguccggcuccugaccaagcccugggacgggaucccgauggugacccagaucgcgaugaccgacacgacccccuucggccagcagcgcgucuucaaggagaagguggacacccggacgccccgggccaagcggggcacgacccagaucauggaggugaccgccaaguggcuguggggguuccucucccgcaacaagaagccgcggaucugcacccgcgaggaguucacgcggaagguccgcagcaacgccgccaucggcgcgguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggcgaagggcagccgggccaucugguacauguggcugggggcccgcuuccuggaguucgaggcccucggcuucaugaacgaggaccacugguucagccgggagaacucccugagcggggucgagggcgaggggcugcacaagcucggcuacauccugcgcgacaucuccaagauccccggcgggaacauguacgccgacgacaccgcgggcugggacacccggaucacggaggacgaccugcagaacgaggccaagaucaccgagaucauggagcccgagcacgcccuccuggccaccagcaucuucaagcugaccuaccagaacaagguggugcgcguccagcgccccgccaagaacgggacggugauggacgugaucucccggcgcgaccagcggggcagcggccaggucgggaccuacggccucaacaccuucaccaacauggaggugcagcugauccgccagauggaguccgaggggaucuuccugccgagcgagcucgagacgcccaaccuggcggagcgggugcuggacuggcucgagaagcacggcgccgagcgccugaagcggauggccaucuccggggacgacugcgucgugaagcccaucgacgaccgcuucgccaccgcccugaccgcgcucaacgacaugggcaaggugcggaaggacaucccccagugggagccgagcaagggcuggaacgacuggcagcagguccccuucugcucccaccacuuccaccagcugaucaugaaggacgggcgcgagaucguggugcccugccggaaccaggacgagcuggucggccgcgcccgggugagccagggggccggcuggucccuccgcgagaccgccugccugggcaagagcuacgcccagauguggcagcugauguacuuccaccggcgcgaccuccggcuggcggccaacgccaucugcuccgccgugcccgucgacugggugccgaccagccgcacgaccugguccauccacgcgcaccaccaguggaugaccaccgaggacaugcugagcguguggaaccgggucuggaucgaggagaaccccuggauggaggacaagacgcacgugagcuccugggaggaggugcccuaccucggcaagcgcgaggaccaguggugcggcagccugaucgggcugaccgcccgcgccaccugggccaccaacauccaggucgccaucaaccaggugcggcgccucaucggcaacgagaacuaccuggacuacaugacguccaugaagcgguucaagaacgagagcgaccccgagggggcgcugugguga

SEQ ID NO: 8096 - RNA, 9879 nt, Artificial Sequence
  derived and/or modified CDS sequence (opt1) from DENV-1__GQ868533__SS-prME
agcgugaccaugcugcucaugcugcugcccaccgcccucgccuuccaccugaccacccggggcggggagccccacaugaucgugagcaagcaggagcggggcaagagccugcuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcguggagaccugggcccugcggcaccccggguucacggugaucgcccuguuccucgcgcacgccaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucgaggccgacauccagaacaccaccuucaucaucgacggccccgacaccccggagugccccgacaaccagcgggccuggaacaucugggagguggaggacuacggguucggcaucuucacgaccaacaucuggcugaagcuccgcgacuccuacacccagaugugcgaccaccggcugaugagcgcggccaucaaggacuccaaggccguccacgccgacaugggguacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacggcgggccgaucucccagcacaacuaccggcccggcuacuucacccagacggccgggcccuggcaccugggcaagcucgagcuggacuucgaccugugcgaggggaccaccgucgugguggacgagcacugcggcaaccgcggcccgagccuccggaccacgaccgucaccgggaagaucauccacgaguggugcugccgcuccugcacccugccgccccugcgguuccgcggcgaggacgggugcugguacggcauggagauccggcccgugaaggagaaggaggagaaccucgugcgcagcauggucuccgccgggagcggcgagguggacagcuucucccugggcauccugugcgccagcaucaugaucgaggaggugaugcggucccgcuggagccggaagaugcucaugacggggacccuggccgucuuccugcuccuggugaugggccagcugaccuggaacgaccucauccgccugugcaucauggugggggcgaacgccuccgaccgcaugggcauggggaccacguaccuggcccucauggccaccuucaagaugcggccgauguucgccgucgggcugcuguuccgccggcucaccagccgcgaggugcugcugcucaccaucggccugucccugguggcgagcgucgagcuccccaacucccuggaggagcugggggacggccucgccauggggaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucggcugcaagccccugaccauguuccucaucacggagaacaagaucugggggcggaaguccuggccccugaacgagggcaucauggccaucgggaucgugagcauccugcucuccagccugcugaagaacgacgugccccucgccggcccgcugaucgccgggggcaugcugaucgccugcuacgucaucagcggcuccagcgcggaccucucccuggagaaggccgccgaggugagcugggagcaggaggccgagcacuccgggaccagccacaacauccugguggagguccaggacgacggcaccaugaagaucaaggacgaggagcgcgacgacacccucacgauccugcugaaggccacccuccuggcgguguccgggguguaccccaugagcauccccgccacccuguuccucugguacuucuggcagaagaagaagcagcgguccggcguccugugggacacccccagcccgcccgagguggagcgcgccgugcuggacgacgggaucuaccggauccugcagcgcggccuccugggccggucccaggucggggugggcguguuccaggacggggucuuccacacgauguggcacgugacccgcggcgccgugcugauguaccaggggaagcggcucgagcccagcugggccuccgucaagaaggaccugaucagcuacggcggcggguggcgcuuccagggcuccuggaacaccggggaggagguccaggugaucgcggucgagcccggcaagaacccgaagaacgugcagaccacgcccgggaccuucaagacccccgagggcgaggugggcgccaucgcccuggacuucaagcccgggaccagcggcuccccgaucgucaaccgggaggggaagaucgugggccucuacggcaacgggguggucacgaccagcggcaccuacguguccgccaucgcccaggcgaaggccagccaggaggggccccugcccgagaucgaggacgagguguucaagaagcgcaaccugaccaucauggaccuccacccgggcagcgggaagacgcggcgcuaccugcccgccaucguccgggaggccaucaagcgcaagcugcggacccucauccuggcgcccacccgcgugguggccuccgagauggccgaggcccugaagggcaugcccauccgcuaccagaccacggccgucaagagcgagcacaccggccgggagaucguggaccucaugugccacgcgaccuucaccaugcgccugcuguccccggugcggguccccaacuacaacaugaucaucauggacgaggcccacuucacggaccccgccagcaucgccgcccgcggguacaucuccacccgggugggcaugggggaggcggccgccaucuucaugaccgccacgccgcccggcagcguggaggccuucccccaguccaacgcggucauccaggacgaggagcgcgacauccccgagcggagcuggaacuccggguacgacuggaucacggacuuccccggcaagaccgugugguucgugcccagcaucaaguccggcaacgacaucgccaacugccuccgcaagaacgggaagcgggucauccagcugagccgcaagaccuucgacaccgaguaccagaagacgaagaacaacgacugggacuacguggugaccaccgacaucuccgagaugggcgccaacuuccgggccgaccgcgucaucgacccccggcgcugccugaagcccgugauccucaaggacgggcccgagcgggugauccuggcgggcccgaugcccgucaccguggccagcgccgcccagcgccgggggcgcaucggccggaaccagaacaaggagggcgaccaguacguguacauggggcagccccugaacaacgacgaggaccacgcccacuggacggaggcgaagaugcuccuggacaacaucaacacccccgagggcaucaucccggcccuguucgagcccgagcgcgagaaguccgccgccaucgacggggaguaccgccuccggggcgaggcccgcaagaccuucgucgagcugaugcggcgcggggaccugcccguguggcucagcuacaaggucgcguccgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacuccgacccgcuggcccugcgcgaguucaaggaguucgccgccggccggcgcagcgucagcggggaccucauccuggagaucggcaagcugccccagcaccucacgucccgggcgcagaacgcccuggacaaccuggugaugcuccacaacagcgagcagggcgggaaggccuaccgccacgccauggaggagcugcccgacaccaucgagacccugaugcuccuggcgcugaucgccgugcucaccggcggggucacgcuguucuuccuguccggcaaggggcucggcaagaccagcaucggccugcugugcgugaccgccuccagcgcccuccuguggauggccuccguggagccccacuggaucgcggccagcaucauccuggaguucuuccucaugguccugcugaucccggagcccgaccggcagcgcacgccccaggacaaccagcucgccuacguggugaucgggcugcuguucaugauccucacggucgccgccaacgagaugggccugcuggagaccaccaagaaggaccucgggaucggccacguggcggccgagaaccaccagcacgccaccaugcuggacguggaccugcggccggccuccgccuggacgcucuacgcggucgccaccaccgugaucacccccaugaugcgccacacgaucgagaacaccaccgccaacaucagccugaccgccaucgccaaccaggcggccauccugauggggcucgacaagggcuggcccaucuccaagauggacaucggcgugccccugcuggcccucgggugcuacagccaggucaacccgcugacgcugaccgccgcggugcucaugcugguggcccacuacgccaucaucggccccgggcugcaggccaaggccacccgggaggcgcagaagcgcaccgccgccggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccggcccgcucaccacccugugggaggggucccccggcaaguucuggaacacgaccaucgccgugagcauggccaacaucuuccggggguccuaccuggccggcgcgggccucgccuucagccugaugaagucccucgggggcgggcgccgggggaccggggcccagggcgagacccucggcgagaaguggaagcgccagcugaaccagcugagcaagagcgaguucaacacguacaagcgguccgggaucauggagguggaccgcagcgaggccaaggagggccucaagcgcggggagaccaccaagcacgcggucucccgcggcaccgccaagcugcggugguucguggagcgcaaccuggugaagcccgaggggaaggucaucgaccugggcugcggccgcggcggguggagcuacuacugcgccgggcucaagaaggugaccgaggugaagggguacacgaagggcgggcccggccacgaggagccgauccccauggccaccuacggguggaaccuggccaagcugcacuccggcaaggacgucuucuucaugccgcccgagaagugcgacacccuccugugcgacaucggggagagcuccccgaaccccaccaucgaggagggccgcacgcugcgggugcucaagaugguggagcccuggcugcgcgggaaccaguucugcaucaagauccugaaccccuacaugccgagcgucguggagacccucgagcagaugcagcggaagcacggcggcaugcuggugcgcaacccccugucccggaacagcacccacgagauguacugggucuccugcgggaccggcaacaucgugagcgcggugaacaugacgucccgcaugcuccugaaccgguucaccauggcccaccgcaagcccaccuacgagcgcgacgucgaccugggggccggcacccggcacguggccguggagcccgaggucgccaaccucgacaucaucggccagcgcaucgagaacaucaagaacgagcacaagagcacguggcacuacgacgaggacaacccguacaagaccugggcguaccacggguccuacgaggucaagagcuccggcagcgccuccagcauggugaacggggucgugcggcugcugaccaagcccugggacgugauccccauggucacccagaucgccaugacggacaccacccccuucggccagcagcgcguguucaaggagaaggucgacacccggacgccgcgcgccaagcgggggaccacccagaucauggaggugaccgccaaguggcucuggggcuuccugagccgcaacaagaagccccggaucugcacgcgcgaggaguucacccggaaggugcgcuccaacgcggccaucggcgccgucuucguggacgagaaccaguggaacagcgccaaggaggcgguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcgggguggagggcgaggggcuccacaagcugggcuacauccugcgcgacaucuccaagauccccgggggcaacauguacgccgacgacaccgccggcugggacacgcggaucaccgaggacgaccuccagaacgaggccaagaucaccgagaucauggagccggagcacgcccugcuggcgaccagcaucuucaagcucacguaccagaacaaggucgugcgcgugcagcgccccgccaagaacgggaccgucauggacgugaucucccggcgcgaccagcggggcagcggccaggugggcaccuacggccugaacaccuucacgaacauggagguccagcugauccgccagauggaguccgaggggaucuuccuccccagcgagcuggagacccccaaccuggccgagcgggugcucgacuggcuggagaagcacggcgccgagcgccugaagcggauggccaucuccggggacgacugcguggucaagccgaucgacgaccgcuucgcgaccgcccucaccgcccugaacgacaugggcaaggugcggaaggacaucccccagugggagcccagcaagggguggaacgacuggcagcagguccccuucugcucccaccacuuccaccagcugaucaugaaggacggccgcgagaucgucgugccgugccggaaccaggacgagcucgugggccgcgcccgggucagccagggggccggcuggucccugcgcgagaccgcgugccugggcaagagcuacgcccagauguggcagcucauguacuuccaccggcgcgaccugcggcuggccgccaacgcgaucugcagcgccgugcccguggacuggguccccacgucccgcaccaccuggagcauccacgcccaccaccaguggaugaccacggaggacaugcucuccguguggaaccggguguggaucgaggagaaccccuggauggaggacaagacccacgucagcuccugggaggaggugccguaccugggcaagcgcgaggaccaguggugcgggagccugaucggccucaccgcccgcgccaccugggcgacgaacauccagguggccaucaaccagguccggcgccugaucggcaacgagaacuaccuggacuacaugaccuccaugaagcgguucaagaacgagagcgaccccgagggggcccucugguga

SEQ ID NO: 8097 - RNA, 9879 nt, Artificial Sequence
  derived and/or modified CDS sequence (opt1) from DENV-1__GQ868534__SS-prME
agcgugaccaugcugcucaugcugcugcccaccgcccucgccuuccaccugaccacccggggcggggagccgcacaugaucgugagcaagcaggagcggggcaagagccuccuguucaagaccuccgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaagaacgccgccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcgcggaccuacagcgacccgcucgcccugcgcgaguucaaggaguucgccgccgggcggcgcuccgugagcggcgaccugauccucgagaucggcaagcugccccagcaccugacgcuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccgggggcgugacgcuguucuuccuguccgggaagggccucggcaagaccagcaucgggcugcugugcgucaccgccuccagcgcccuccuguggauggccuccguggagccccacuggaucgccgcgagcaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccuccgccuggacgcucuacgccguggcgaccaccgucaucacccccaugaugcgccacacgaucgagaacaccaccgccaacaucagccugaccgccaucgccaaccaggccgcgauccugaugggccucgacaagggcuggcccaucuccaagauggacaucggggugccccugcuggcccucggcugcuacagccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccgggccgcucaccacccugugggagggcucccccgggaaguucuggaacacgaccaucgccgucagcauggccaacaucuuccggggcuccuaccuggccggcgccgggcucgcguucagccugaugaagucccugggcgggggccgccgggggaccggcgcccagggcgagacccucggggagaaguggaagcgccagcugaaccagcugagcaaguccgaguucaacacguacaagcggagcggcaucauggagguggaccgcagcgaggccaaggaggggcucaagcggggcgagaccaccaagcacgccgugucccgcgggaccgcgaagcugcggugguucgucgagcgcaaccuggugaagcccgagggcaaggugaucgaccugggcugcgggcggggcggguggagcuacuacugcgccggccucaagaaggucaccgaggugaagggguacacgaagggcggccccgggcacgaggagccgauccccauggccaccuacggcuggaaccuggugaagcugcacuccgggaaggacgucuucuucaucccgcccgagaagugcgacacccuccugugcgacaucggcgagagcuccccgaaccccaccaucgaggaggggcgcacgcugcgggugcucaagaugguggagcccuggcugcgcggcaaccaguucugcaucaagauccugaaccccuacaugccgagcgucguggaggcccucgagcagaugcagcggaagcacggcgggaugcuggugcgcaacccccugucccggaacagcacccacgagauguacugggucuccugcggcaccgggaacaucgugagcgccgugaacaugaccucccgcaugcuccugaaccgguucacgauggcgcaccgcaagcccaccuacgagcgcgacgucgaccugggcgccggcacccggcacguggccguggagcccgaggucgccaaccucgacaucaucgggcagcgcaucgagaacaucaagaacgagcacaagagcaccuggcacuacgacgaggacaacccguacaagacgugggccuaccacggcuccuacgaggugaagcccagcggguccgcgagcuccauggugaacggcgucgugcggcugcugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcucuggggcuuccugagccgcaacaagaagccccggaucugcacccgcgaggaguucacgcggaaggugcgcuccaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgcggacgacaccgccgggugggacacccggaucacggaggacgaccuccagaacgaggccaagaucaccgagaucauggagcccgagcacgcccugcuggccaccuccaucuucaagcucaccuaccagaacaaggucgugcgcgugcagcgccccgcgaagaacggcacggucauggacgugaucagccggcgcgaccagcggggguccggccaggugggcaccuacgggcugaacaccuucaccaacauggagguccagcugauccgccagauggagagcgagggcaucuuccuccccuccgagcuggagacgccgaaccuggccgagcgggcccucgacuggcuggagaagcacggggccgagcgccugaagcggauggccaucagcggcgacgacugcguggugaagcccaucgacgaccgcuucgcgaccgcccucaccgcccugaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccguccccguggacugggugcccaccucccgcacgaccuggagcauccacgcccaccaccaguggaugaccaccgaggacaugcucagcgucuggaaccggguguggaucgaggagaacccguggauggaggacaagacgcacguguccagcugggaggagguccccuaccuggggaagcgcgaggaccaguggugcggcucccugaucggccucaccgcccgcgccaccugggcgaccaacauccagguggccaucaaccaggugcggcgccugaucgggaacgagaacuaccuggacuacaugacgagcaugaagcgguucaagaacgaguccgaccccgagggcgcccucugguga

SEQ ID NO: 8098 - RNA, 9879 nt, Artificial Sequence
  derived and/or modified CDS sequence (opt1) from DENV-1__GQ868535__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucgcgaaccccgccauccuccgcaagcugugcaucgaggccaagaucagcaacaccaccaccgacucccggugcccgacgcagggcgaggccacccugguggaggagcaggacgccaacuucgugugccgccggaccuucgucgaccgcggcugggggaacggcugcggccucuucggcaaggggagccugcugaccugcgcgaaguucaagugcgugacgaagcucgagggcaagaucgugcaguacgagaaccugaaguacuccgucaucgugaccgugcacaccggcgaccagcaccaggucgggaacgagaccacggagcacggcaccaucgccaccaucacgccccaggcccccaccagcgagauccagcugacggacuacggggcccucacccuggacugcagcccccggaccggccuggacuucaacgagauggugcuccugaccaugaaggagaaguccuggcugguccacaagcagugguuccucgaccugccgcugcccuggacguccggggccagcaccagccaggagaccuggaaccgccaggaccuccuggugaccuucaagacggcgcacgccaagaagcaggagguggucgugcugggcucccaggagggcgccaugcacaccgcccucaccggggccaccgagauccagacgagcggcaccaccaccaucuucgcggggcaccugaagugccggcugaagauggacaagcucacgcugaagggcaccuccuacgugaugugcaccgggagcuucaagcuggagaaggaggucgccgagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgcgggcgagaaggcccugaagcuguccugguucaagaaggggagcuccaucggcaagauguucgaggccaccgcccgcggggcccgccggauggcgauccucggcgacacggccugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccguggucgugggggacgcgaacggcauccuggcccaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggcguggaacaucugggagguggaggacuacggcuucgggaucuucaccacgaacaucuggcugaagcuccgcgacuccuacacccagaugugcgaccaccggcugaugagcgccgccaucaaggacuccaaggccguccacgccgacaugggcuacuggaucgagagcgagaagaacgagaccuggaagcuggcgcgcgccuccuucaucgaggugaagaccugcacguggcccaagagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcacgaccgucgugguggacgagcacugcggcaaccgcgggccgagccuccggaccaccacggucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacgcuggcggucuuccugcuccugaucauggggcagcugaccuggaacgaccucauccgccugugcaucauggugggcgccaacgccuccgaccgcauggggaugggcaccaccuaccuggcccucauggccacguucaagaugcggccgauguucgcgguggggcugcuguuccgccggcucaccagccgcgagguccugcugcucaccaucgggcugucccugguggccagcguggagcuccccaacucccuggaggagcugggcgacgggcucgccaugggcaucaugaugcugaagcugcucaccgaguuccagccccaccagcuguggacgacccugcucagccugaccuucaucaagaccacgcugucccucgacuacgccuggaagaccaccgcgauggcccugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgcgugcuacgugaucagcggguccagcgccgaccucucccuggagaaggccgccgaggucagcugggagcaggaggccgagcacuccggcacgagccacaacauccugguggaggugcaggacgacgggaccaugaagaucaaggacgaggagcgcgacgacacccucaccauccugcugaaggcgacgcuccuggccgucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacgcgcggggccgugcugauguaccagggcaagcggcuggagcccagcugggcguccgucaagaaggaccucaucagcuacggcgggggcuggcgcuuccagggguccuggaacaugggcgaggagguccaggugaucgccgucgagcccgggaagaacccgaagaacgugcagaccacccccggcaccuucaagacgcccgagggcgaggugggggccaucgcccuggacuucaagcccggcaccagcggguccccgaucgucaaccgggagggcaagaucgugggccuguacgggaacggcguggucaccaccagcgggacguacguguccgccaucgcgcaggccaaggccagccaggagggcccccuccccgagaucgaggacgagguguucaagaagcgcaaccugaccaucauggaccugcacccggggagcggcaagacccggcgcuaccuccccgccaucguccgggaggcgaucaagcgcaagcugcggacccugauccucgcccccacgcgcgugguggccuccgagauggccgaggcccugaagggcaugcccauccgcuaccagaccaccgcggucaagagcgagcacaccgggcgggagaucguggaccugaugugccacgccacguucaccaugcgccuccuguccccggugcggguccccaacuacaacaugaucaucauggacgaggcccacuucaccgaccccgccagcaucgccgcgcgcggcuacaucuccacccggguggggaugggcgaggccgccgccaucuucaugacggccacgccgcccgggagcguggaggcguucccccaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagacguucgacaccgaguaccagaagaccaagaacaacgacugggacuacguggugaccacggacaucuccgagaugggggccaacuuccgggcggaccgcgucaucgacccccggcgcugccugaagcccgugauccugaaggacggccccgagcgggugauccucgccgggccgaugcccgucaccguggccagcgccgcccagcgccggggccgcaucggccggaaccagaacaaggagggggaccaguacguguacaugggccagccccugaacaacgacgaggaccacgcgcacuggaccgaggccaagaugcugcucgacaacaucaacacccccgaggggaucaucccggcccuguucgagcccgagcgcgagaaguccgccgccaucgacggcgaguaccgccugcgcggggaggcgcgcaagacguucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgcggggcggcgcagcgucagcggcgaccugauccucgagaucggcaagcugccccagcaccugacccuccgggcccagaacgcccuggacaaccuggugaugcuccacaacuccgagcagggcgggaaggccuaccgccacgcgauggaggagcugcccgacaccaucgagacgcugaugcuccuggcccugaucgccgugcucaccgggggcgucacccuguucuuccugagcgggaagggccucggcaagaccuccaucgggcugcugugcgugacggccagcuccgcccuccuguggauggcgagcguggagccccacuggaucgccgccuccaucauccuggaguucuuccucaugguccugcugaucccggagcccgaccggcagcgcacgccccaggacaaccagcucgccuacguggugaucggccugcuguucaugauccucaccgucgccgcgaacgagauggggcugcuggagaccacgaagaaggaccucggcaucgggcacguggccgccgagaaccaccagcacgccaccaugcuggacguggaccugcggccggccagcgcguggacccucuacgccgucgccaccacggugaucacccccaugaugcgccacaccaucgagaacaccacggccaacaucucccugaccgccaucgcgaaccaggccgccauccugaugggccucgacaagggcuggcccaucagcaagauggacaucggggugccccugcuggcccucggcugcuacucccaggucaacccgcugacccugaccgcggccgugcucaugcugguggcccacuacgccaucaucgggcccggccugcaggccaaggcgacgcgggaggcccagaagcgcaccgccgccgggaucaugaagaaccccaccgucgacggcaucguggccaucgaccucgaccccguggucuacgacgcgaaguucgagaagcagcugggccagaucaugcugcucauccugugcaccagccagauccugcucaugcgcacgaccugggcccugugcgaguccaucacccuggccaccgggccgcucacgacccugugggagggcagccccgggaaguucuggaacaccaccaucgccguguccauggccaacaucuuccggggcagcuaccuggcgggcgccgggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggagguggaccgcuccgaggcgaaggaggggcucaagcggggcgagaccacgaagcacgccgucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacaccaagggcggccccgggcacgaggagccgauccccauggccaccuacggcuggaaccuggucaagcugcacagcgggaaggacguguucuucaugccgcccgagaagugcgacacgcuccugugcgacaucggcgaguccagcccgaaccccaccaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacgcacgagauguacugggugagcugcggcaccgggaacaucguguccgcggucaacaugaccagccgcaugcuccugaaccgguucaccauggcccaccgcaagcccacguucgagcgcgacguggaccugggcgccggcacccggcacguggccgucgagcccgagguggccaaccucgacaucaucgggcagcgcaucgagaacaucaagaacgagcacaaguccaccuggcacuacgacgaggacaacccguacaagaccugggcguaccacggcagcuacgaggugaagcccuccgggagcgccuccagcauggucaacggcguggugcggcugcugacgaagcccugggacgucauccccauggugacccagaucgccaugaccgacaccacgccguucgggcagcagcgcgucuucaaggagaagguggacacccggacgccccgggccaagcggggcaccacgcagaucauggaggugaccgccaaguggcucuggggcuuccugucccgcaacaagaagccccggaucugcacccgcgaggaguucacccggaagguccgcagcaacgcggccaucggggccguguucguggacgagaaccaguggaacagcgccaaggaggcggucgaggacgagcgguucugggaccuggugcaccgcgagcgggagcuccacaagcagggcaagugcgccacgugcguguacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcgucgagggggagggccuccacaagcugggguacauccugcgcgacaucuccaagaucccgggcggcaacauguacgccgacgacaccgccgggugggacacccggaucaccgaggacgaccuccagaacgaggccaagaucacggacaucauggagcccgagcacgcccugcuggcgaccagcaucuucaagcucaccuaccagaacaagguggugcgcguccagcgccccgccaagaacggcaccgugauggacgugaucucccggcgcgaccagcgggggagcggccaggucggcacguacgggcugaacaccuucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgcgacggcccucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgcgugccugggcaagagcuacgcccagauguggcagcucauguacuuccaccggcgcgaccugcggcuggccgccaacgcgaucugcuccgccgugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucacggcccgcgccaccugggcgaccaacauccaggucgccaucaaccaggugcggcgccugaucgggaacgagaacuaccuggacuacaugaccuccaugaagcgguucaagaacgagagcgaccccgagggcgcccucugguga

SEQ ID NO: 8099 - RNA, 9879 nt, Artificial Sequence
  derived and/or modified CDS sequence (opt1) from DENV-1__KJ189306__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcagcgagggcgccuggaagcagauccagcgcguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggcccuucaagcuggagaaggaggucgcggagacgcagcacggcaccgugcuggugcaggucaaguacgagggcaccgacgcccccugcaagaucccguuccucacccaggacgagaagggggugacgcagaacggccgccugaucaccgccaaccccaucgugaccgacaaggagaagcccgucaacaucgagaccgagcccccguucggggagagcuacaucguggugggcgccggcgagaaggcgcugaagcucuccugguucaagaaggggagcuccaucggcaagauguucgaggccacggcccgcggggcccgccggauggccauccugggcgacaccgcgugggacuucgggagcaucggcggcgucuucaccuccguggggaagcuggugcaccaggucuucggcaccgccuacgggguccuguucagcggcguguccuggacgaugaagaucgggaucggcauccugcugaccuggcucggccugaacagccgcuccaccagccuguccaugaccugcaucgccgucgggauggugacgcucuaccugggcgugaugguccaggccgacagcgggugcgugaucaacuggaagggccgcgagcugaagugcggguccggcaucuucgugaccaacgagguccacaccuggaccgagcaguacaaguuccaggccgacagccccaagcggcucuccgcggccaucggcaaggccugggaggagggggugugcggcauccgcagcgccacccggcuggagaacaucauguggaagcagaucagcaacgagcugaaccacauccuccuggagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggccggacacccccgagugccccgacaaccagcgggccuggaacaucugggagguggaggacuacggcuucgggaucuucacgaccaacaucuggcucaagcugcgcgacuccuacacccagaugugcgaccaccggcugaugagcgcggccaucaaggacuccaaggccguccacgccgacaugggcuacuggaucgagagcgagaagaacgagaccuggaagcucgcccgcgcguccuucaucgaggugaagacgugcaccuggcccaagagccacacccugugguccaacggcgugcuggagagcgagaugaucaucccgaagaucuacgggggccccaucucccagcacaacuaccggcccggguacuucacccagacggccggcccguggcaccucgggaagcuggagcuggacuucgaccucugcgagggcaccaccgucgugguggacgagcacugcggcaaccgcgggcccagccugcggaccacgaccgucaccggcaagaucauccacgaguggugcugccgcuccugcacccugccgccccuccgguuccgcggggaggacggcugcugguacgggauggagauccggccggugaaggagaaggaggagaaccuggugcgcagcauggucuccgccggcagcggcgagguggacuccuucagccuggggauccucugcgugagcaucaugaucgaggaggucaugcggucccgcuggagccggaagaugcugaugacgggcacccuggccguguuccuccugcuggugauggggcagcucaccuggaacgaccugauccgccugugcaucauggucggcgccaacgcguccgaccgcauggggaugggcaccacguaccucgcccugauggccaccuucaagaugcggcccauguucgccguggggcuccucuuccgccggcugaccagccgcgaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuucccgcugugccugagcacgaccucccagaagaccaccuggcuccccgugcugcugggcagcuucgggugcaagccccucaccauguuccugaucacggagaacaagaucuggggccggaaguccuggccccugaacgaggggaucauggcgaucggcaucgugagcauccuccuguccagccugcucaagaacgacgucccgcuggccgggccccugaucgccggcggcaugcucaucgccugcuacgugaucuccgggagcagcgccgaccugucccuggagcgcgcggccgaggugagcugggagcaggaggccgagcacuccggcaccagccacaacauccucgucgaggugcaggacgacgggaccaugaagaucaaggacgaggagcgggacgacacccugacgauccugcucaaggccacccugcuggccguguccggcgucuaccccaugagcauccccgcgacccucuucgugugguacuucuggcagaagaagaagcagcgcuccggggugcugugggacaccccguccccgcccgaggucgagcgggccgugcuggacgacggcaucuaccgcauccugcagcggggccuccuggggcgcucccaggugggcgucgggguguuccaggacggcguguuccacacgauguggcacgucacccgcggggccgugcugauguaccagggcaagcgccucgagcccagcugggccuccgugaagaaggaccugaucagcuacggcgggggcuggcgguuccagggguccuggaacaccggcgaggagguccaggugaucgccguggagccggggaagaaccccaagaacguccagaccacgcccggcaccuucaagacccccgagggcgaggugggggcgaucgcccuggacuucaagccgggcaccagcgggucccccaucgugaaccgcgagggcaagaucgucggccucuacgggaacggcguggugacgaccagcgggaccuacgucuccgccaucgcccaggccaaggcgagccaggagggcccccugccggagaucgaggacgagguguucaagaagcggaaccugaccaucauggaccuccaccccggguccggcaagacgcgccgguaccugcccgccaucgugcgcgaggccaucaagcggaagcugcgcacccucauccuggcccccacccgcgucguggcgagcgagauggccgaggcccugaagggcaugccgauccgguaccagaccacggccgucaagagcgagcacaccgggcgcgagaucgucgaccucaugugccacgccaccuucaccaugcggcugcugucccccgugcgcgugcccaacuacaacaugaucaucauggacgaggcgcacuucacggaccccgccagcaucgccgcccggggcuacaucuccacccgcgucgggaugggcgaggccgcggccaucuucaugaccgccaccccgcccgggagcguggaggccuucccccaguccaacgccgugauccaggacgaggagcgggacauccccgagcgcagcuggaacuccggcuacgacuggaucacggacuucccgggcaagaccgucugguucgugcccagcaucaaguccgggaacgacaucgcgaacugccuccggaagaacggcaagcgcgugauccagcugagccggaagaccuucgacaccgaguaccagaagacgaagaacaacgacugggacuacgucgugaccaccgacaucuccgagaugggggccaacuuccgcgccgaccgggugaucgacccccgccggugccugaagcccgucauccucaaggacggcccggagcgcgugauccuggccgggcccaugcccgugaccgucgcgagcgccgcccagcggcgcggccggaucggccgcaaccagaacaaggagggggaccaguacguguacaugggccagccccugaacaacgacgaggaccacgcccacuggacggaggccaagaugcuccuggacaacaucaacaccccggaggggaucauccccgcgcuguucgagcccgagcgcgagaaguccgccgccaucgacggcgaguaccggcuccgcggggaggcccggaagaccuucgucgagcugaugcgccggggcgaccugcccguguggcucagcuacaagguggccuccgagggcuuccaguacagcgaccgccgguggugcuucgacggggagcgcaacaaccagguccuggaggagaacauggacguggagaucuggaccaaggagggcgagcggaagaagcugcgcccgcgguggcucgacgcgcgcaccuacuccgacccccuggcccugcgggaguucaaggaguucgccgccgggcgccggagcguguccggcgaccucauccuggagaucggcaagcugccccagcaccucacgcugcgcgcccagaacgcgcuggacaaccucgucaugcugcacaacagcgagcagggcgggaaggccuaccggcacgccauggaggagcugcccgacaccaucgagacccucaugcugcuggcccucaucgcggugcugaccgggggcgugacgcuguucuuccucagcgggaagggccugggcaagaccuccaucgggcugcucugcgucaccgccagcuccgcccugcuguggauggccagcguggagccgcacuggaucgccgcguccaucauccucgaguucuuccugauggugcugcucauccccgagcccgaccgccagcggaccccgcaggacaaccagcuggccuacgucgugaucggccuccucuucaugauccugacgguggccgccaacgagauggggcugcucgagaccaccaagaaggaccugggcaucgggcacgucgccgcggagaaccaccagcacgccaccaugcuggacguggaccuccgccccgccagcgccuggacgcuguacgccguggcgaccaccgucaucacccccaugaugcggcacacgaucgagaacaccaccgccaacaucucccugaccgccaucgccaaccaggccgcgauccucaugggccuggacaagggcuggcccaucagcaagauggacaucggggugccgcugcucgcccugggcugcuacucccaggugaacccccugacgcucaccgccgccguccugaugcugguggcgcacuacgccaucaucgggcccggccuccaggccaaggccacccgcgaggcccagaagcgcaccgcggccgggaucaugaagaaccccacgguggacggcaucgucgccaucgaccuggacccggugguguacgacgccaaguucgagaagcagcugggccagaucaugcuccugauccugugcaccagccagauccuccugaugcggaccaccugggcccugugcgaguccaucacgcucgcgaccgggccccugaccacccugugggagggcagccccgggaaguucuggaacacgaccaucgccgucuccauggccaacaucuuccgcggcagcuaccucgccggcgccgggcuggcguucucccugaugaagucccucggcgggggccggcgcgggaccggcgcccagggcgagacccugggggagaaguggaagcggcagcugaaccagcucuccaagagcgaguuccacaucuacaagcgcuccggcaucauggagguggaccggagcgaggccaaggaggggcugaagcgcggcgagacgaccaagcacgccgugagccgggggaccgcgaagcugcgcugguucgucgagcggaaccuggugaagcccgagggcaaggugaucgaccucggcugcgggcgcggcgggugguccuacuacugcgccggccugaagaaggucaccgaggugaagggguacaccaagggcggcccggggcacgaggagcccauccccauggccacguacggcuggaaccuggugaagcuccacagcgggaaggacgucuucuucaugcccccggagaagugcgacacccugcugugcgacaucggcgaguccagccccaaccccaccaucgaggaggggcggacccuccgcgugcugaagaugguggagcccuggcugcggggcaaccaguucugcaucaagauccucaacccguacaugcccuccgucguggagacgcuggagcagaugcagcgcaagcacggcgggaugcuggugcggaacccccucagccgcaacuccacccacgagauguacugggucagcugcggcaccgggaacaucguguccgccgugaacaugaccagccggaugcugcugaaccgcuucacgauggcccaccgcaagcccaccuacgagcgggacgucgaccucggcgcgggcacccgccacguggccguggagccggaggucgccaaccuggacaucaucgggcagcggaucgagaacaucaagaacgagcacaaguccaccuggcacuacgacgaggacaaccccuacaagacgugggccuaccacggcagcuacgaggugaagcccuccgggagcgccuccagcauggugaacggcgucgugcgccugcucaccaagcccugggacgucaucccgauggugacccagaucgcgaugaccgacacgacccccuucgggcagcagcggguguucaaggagaaggucgacacccgcacgccccgggccaagcgcggcacgacccagaucauggaggugaccgccaaguggcuguggggcuuccugucccggaacaagaagccgcgcaucugcacccgggaggaguucauccgcaaggugcggagcaacgccgccaucggggcggucuucguggacgagaaccaguggaacuccgccaaggaggccguggaggacgagcgcuucugggaccucguccaccgggagcgcgagcugcacaagcagggcaagugcgccacgugcguguacaacaugauggggaagcgggagaagaagcugggcgaguucgggaaggcgaagggcagccgcgccaucugguacauguggcucggcgcccgguuccuggaguucgaggcccugggguucaugaacgaggaccacugguucagccgcgagaacucccucagcggcguggagggggagggccugcacaagcugggguacauccuccgggacaucuccaagauccccggcggcaacauguacgccgacgacaccgcggggugggacacccgcaucaccgaggacgaccugcagaacgaggccaagaucacggagaucauggagcccgagcacgcccugcucgccaccagcaucuucaagcugaccuaccagaacaaggucgugcgcgugcagcggcccgccaagaacggcaccgucauggacgugaucucccgccgggaccagcgcgggagcggccaggugggcacguacgggcugaacaccuucaccaacauggagguccagcucauccggcagauggaguccgagggcaucuuccugccgagcgagcuggagacccccaaccucgcggagcgcgugcuggacuggcuggagaagcacggggccgagcggcucaagcgcauggccaucuccggcgacgacugcguggucaagcccaucgacgaccgguucgccacggcccugaccgcgcugaacgacauggggaaggugcgcaaggacaucccccagugggagccgagcaagggcuggaacgacuggcagcagguccccuucugcucccaccacuuccaccagcucaucaugaaggacggccgggagaucgucgugcccugccgcaaccaggacgagcugguggggcgggcccgcgucagccagggcgccggguggucccugcgggagaccgccugccucggcaagagcuacgcccagauguggcagcugauguacuuccaccgccgggaccugcgccucgcggccaacgccaucugcuccgccgugcccguggacugggucccgaccagccggaccacgugguccauccacgcgcaccaccaguggaugaccaccgaggacaugcugagcguguggaaccgcguguggaucgaggagaaccccuggauggaggacaagacccacgucagcuccugggaggaggugcccuaccuggggaagcgcgaggaccaguggugcggcagccucaucggccugacggcccgggccaccugggccaccaacauccagguggccaucaaccagguccgccggcugaucgggaacgagaacuaccucgacuacaugaccuccaugaagcgcuucaagaacgagagcgaccccgagggcgcgcugugguga

SEQ ID NO: 8100 - RNA, 9879 nt, Artificial Sequence
  derived and/or modified CDS sequence (opt1) from DENV-1__KJ189307__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcacccgggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcgauccugcgcaagcucugcaucgaggccaagaucagcaacaccaccacggacucccggugcccgacccagggcgaggccacccugguggaggagcaggacgccaacuucgugugccgccggaccuucgucgaccgcggcugggggaacggcugcgggcuguucggcaaggggagccuccugacgugcgccaaguucaagugcgugaccaagcuggagggcaagaucgugcaguacgagaaccucaaguacuccgucaucgugaccgugcacaccggcgaccagcaccaggucgggaacgagacgaccgagcacggcaccaucgcgaccaucaccccccaggcccccacgagcgagauccagcugaccgacuacggggcccugacccucgacugcuccccccggaccggccuggacuucaacgagauggugcugcucacgaugaaggagaagagcuggcugguccacaagcagugguuccuggaccucccgcugcccuggaccuccggggccagcaccagccaggagaccuggaaccgccaggaccugcucgugacguucaagaccgcccacgcgaagaagcaggagguggucgugcugggcucccaggagggcgccaugcacaccgcccugaccggggccacggagauccagaccagcggcaccaccacgaucuucgccgggcaccucaagugccggcugaagauggacaagcugacccucaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccccccuucggggagagcuacaucguggugggcgccggcgagaaggcgcucaagcuguccugguucaagaaggggagcuccaucggcaagauguucgaggccacggcccggggggcccgccggauggccauccugggcgacaccgcgugggacuucgggagcaucggcggcgucuucaccuccguggggaagcucgugcaccaggucuucggcaccgccuacggggugcuguucagcggcguguccuggacgaugaagaucgggaucggcauccugcucaccuggcugggccugaacagccgcuccaccagccucuccaugaccugcaucgccgucgggauggugacgcuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacgguggucgugggggacgccaacggcauccucgcgcaggggaagaagaugauccgcccccagcccauggagcacaaguacuccuggaagagcuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccugugguccaacggcgugcucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccuccccccccugcgguuccgcggggaggacggcugcugguacgggauggagauccggcccgugaaggagaaggaggagaaccuggugcgcagcauggucuccgccggcagcggcgagguggacagcuucucccucgggauccugugcgugagcaucaugaucgaggaggucaugcggucccgcuggagccggaagaugcugaugacgggcacccucgccguguuccugcugcucgugauggggcagcugaccuggaacgaccugauccgccucugcaucauggucggcgccaacgcguccgaccgcauggggaugggcaccacguaccuggcccugauggccaccuucaagaugcggccgauguucgccgugggccuccuguuccgccggcugaccagccgcgaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccauggcccucagcaucgucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccccgucgaggugcaggacgacgggaccaugaagaucaaggacgaggagcgcgacgacacccugacgauccugcucaaggccacccugcuggccguguccggcgucuaccccaugagcauccccgcgacccucuucgugugguacuucuggcagaagaagaagcagcgguccggggugcugugggacaccccgagcccccccgaggucgagcgcgccgugcuggacgacggcaucuaccggauccuccagcgcggccugcuggggcggucccaggugggcgucgggguguuccaggacggcguguuccacacgauguggcacgucacccgcggggccgugcugauguaccagggcaagcggcucgagcccagcugggccuccgugaagaaggaccugaucagcuacggcgggggcuggcgcuuccagggguccuggaacaccggcgaggagguccaggugaucgccguggagccggggaagaaccccaagaacguccagaccacgcccggcaccuucaagacccccgagggcgaggugggggcgaucgcccuggacuucaagccgggcaccagcgggucccccaucgugaaccgggagggcaagaucgucggccucuacgggaacggcguggugacgaccagcgggaccuacgucuccgccaucgcccaggccaaggcgagccaggagggcccccugccggagaucgaggacgagguguucaagaagcgcaaccugaccaucauggaccuccaccccgggagcggcaagacgcggcgcuaccugcccgccaucgugcgggaggccaucaagcgcaagcugcggacccucauccuggcccccacccgcgucguggcguccgagauggccgaggcccugaagggcaugccgauccgcuaccagaccacggccgugaagagcgagcacaccgggcgggagaucgucgaccucaugugccacgccaccuucaccaugcgccugcugucccccgugcgggugcccaacuacaacaugaucaucauggacgaggcgcacuucacggaccccgccagcaucgccgcccgcggcuacaucuccacccgggucgggaugggcgaggccgcggccaucuucaugaccgccaccccgcccgggagcguggaggccuucccccaguccaacgccgugauccaggacgaggagcgcgacauccccgagcggagcuggaacuccggcuacgacuggaucacggacuucccgggcaagaccgucugguucgugcccagcaucaaguccgggaacgacaucgcgaacugccuccgcaagaacggcaagcgggugauccagcugagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccucaaggacggcccggagcgggugauccuggccgggcccaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcuccuggacaacaucaacaccccggaggggaucauccccgcgcuguucgagcccgagcgcgagaagaacgccgccaucgacggcgaguaccgccuccggggggaggcccgcaagaccuucgucgagcugaugcggcgcggcgaccugcccguguggcucuccuacaagguggccagcgagggcuuccaguacuccgaccggcgcuggugcuucgacggggagcggaacaaccagguccuggaggagaacauggacguggagaucuggaccaaggagggcgagcgcaagaagcugcggccgcgcuggcucgacgcgcggaccuacagcgacccccuggcccugcgcgaguucaaggaguucgccgccgggcggcgcuccgugagcggcgaccucauccuggagaucggcaagcugccccagcaccucacgcugcgggcccagaacgcgcuggacaaccucgucaugcugcacaacagcgagcaggggggcaaggccuaccgccacgccauggaggagcugcccgacaccaucgagacccucaugcugcuggcccucaucgcggugcugaccgggggcgugacgcuguucuuccucuccgggaagggccugggcaagaccagcaucgggcugcucugcgucaccgccuccagcgcccugcuguggauggccuccguggagccgcacuggaucgccgcgagcaucauccucgaguucuuccugauggugcugcucauccccgagcccgaccggcagcgcaccccgcaggacaaccagcuggccuacgucgugaucggccugcucuucaugauccugacgguggccgccaacgagauggggcugcucgagaccaccaagaaggaccugggcaucgggcacgucgccgcggagaaccaccagcacgccaccaugcuggacguggaccuccggcccgccuccgccuggacgcuguacgccguggcgaccaccgucaucacccccaugaugcgccacacgaucgagaacaccaccgccaacaucagccugaccgccaucgccaaccaggccgcgauccucaugggccuggacaagggcuggcccaucuccaagauggacaucggggugccgcugcucgcccugggcugcuacagccaggugaacccccugacgcucaccgccgccguccugaugcugguggcgcacuacgccaucaucgggcccggccuccaggccaaggccacccgggaggcccagaagcgcaccgcggccgggaucaugaagaaccccacgguggacggcaucgucgccaucgaccuggacccggugguguacgacgccaaguucgagaagcagcugggccagaucaugcuccugauccugugcaccucccagauccuccugaugcgcaccaccugggcccugugcgagagcaucacgcucgcgaccgggccccugaccacccugugggagggcucccccgggaaguucuggaacacgaccaucgccgucagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucagcaaguccgaguucaacacguacaagcggagcggcaucauggagguggaccgcagcgaggccaaggaggggcugaagcggggcgagaccaccaagcacgccgugucccgcgggaccgcgaagcugcggugguucgucgagcgcaaccucgugaagcccgagggcaaggugaucgaccugggcugcgggcggggcggguggagcuacuacugcgccggccugaagaaggucaccgaggugaagggguacacgaagggcggcccggggcacgaggagcccauccccauggccaccuacggcuggaaccuggugaagcuccacuccgggaaggacgucuucuucaugcccccggagaagugcgacacccugcugugcgacaucggcgagagcucccccaaccccaccaucgaggaggggcgcacgcuccgggugcugaagaugguggagcccuggcugcgcggcaaccaguucugcaucaagauccucaacccguacaugcccagcgucguggagacccuggagcagaugcagcggaagcacggcgggaugcuggugcgcaacccccucucccggaacagcacccacgagauguacugggucuccugcggcaccgggaacaucgugagcgccgugaacaugacgucccgcaugcugcugaaccgguucaccauggcccaccgcaagcccaccuacgagcgcgacgucgaccucggcgcgggcacccggcacguggccguggagccggaggucgccaaccuggacaucaucgggcagcgcaucgagaacaucaagaacgagcacaagagcacguggcacuacgacgaggacaaccccuacaagaccugggccuaccacggcuccuacgaggugaagcccagcggguccgccagcuccauggugaacggcgucgugcggcugcucaccaagcccugggacgucaucccgauggugacccagaucgcgaugacggacaccacccccuucgggcagcagcgcguguucaaggagaaggucgacacccggacgccccgcgccaagcggggcaccacccagaucauggaggugaccgccaaguggcuguggggcuuccugagccgcaacaagaagccgcggaucugcacgcgcgaggaguucacccggaaggugcgcuccaacgccgccaucggggcggucuucguggacgagaaccaguggaacagcgccaaggaggccguggaggacgagcgguucugggaccucguccaccgcgagcgggagcugcacaagcagggcaagugcgccaccugcguguacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagauccccggcggcaacauguacgccgacgacaccgcggggugggacacgcggaucaccgaggacgaccugcagaacgaggccaagaucaccgagaucauggagcccgagcacgcccugcucgccaccuccaucuucaagcugacguaccagaacaaggucgugcgcgugcagcgccccgccaagaacggcaccgucauggacgugaucagccggcgcgaccagcggggguccggccaggugggcaccuacgggcugaacaccuucacgaacauggagguccagcucauccgccagauggagagcgagggcaucuuccugccguccgagcuggagacccccaaccucgcggagcgggugcuggacuggcuggagaagcacggggccgagcgccucaagcggauggccaucagcggcgacgacugcguggucaagcccaucgacgaccgcuucgccaccgcccugaccgcgcugaacgacauggggaaggugcggaaggacaucccccagugggagccguccaagggcuggaacgacuggcagcaggugcccuucugcagccaccacuuccaccagcucaucaugaaggacggccgcgagaucgucgugcccugccggaaccaggacgagcugguggggcgcgcccgggucucccagggcgccggguggagccugcgcgagaccgccugccucggcaaguccuacgcccagauguggcagcugauguacuuccaccggcgcgaccugcggcucgcggccaacgccaucugcagcgccgugcccguggacugggucccgacgucccgcaccaccuggagcauccacgcgcaccaccaguggaugaccacggaggacaugcugagcguguggaaccggguguggaucgaggagaaccccuggauggaggacaagacccacgucuccagcugggaggaggugcccuaccuggggaagcgcgaggaccaguggugcggcucccucaucggccugaccgcccgcgccaccugggccacgaacauccagguggccaucaaccagguccggcgccugaucgggaacgagaacuaccucgacuacaugaccagcaugaagcgguucaagaacgaguccgaccccgagggcgcgcugugguga

SEQ ID NO: 8101 - RNA, 9879 nt, Artificial Sequence
  derived and/or modified CDS sequence (opt1) from DENV-1__KJ189318__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgugggccugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaagaccgccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggccgucuccggcguguaccccaugagcauccccgcgacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagacgacccccggcaccuucaagacccccgagggcgaggugggggcgaucgcccuggacuucaagcccggcacgagcggguccccgaucgucaaccgggagggcaagaucgugggccuguacgggaacggcguggucaccaccagcgggaccuacguguccgccaucgcccaggccaaggcgagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcccccacccgcgugguggcguccgagauggccgaggcccugaagggcaugcccauccgcuaccagacgaccgccgucaagagcgagcacaccgggcgggagaucguggaccugaugugccacgccaccuucacgaugcgccuccuguccccggugcggguccccaacuacaacaugaucaucauggacgaggcgcacuucaccgaccccgccagcaucgccgcccgcggcuacaucuccacccggguggggaugggcgaggccgcggccaucuucaugaccgccacgcccccggggagcguggaggccuucccccaguccaacgccgucauccaggacgaggagcgcgacauccccgagcggagcuggaacuccggcuacgacuggaucaccgacuuccccggcaagaccgugugguucgugccgagcaucaaguccgggaacgacaucgcgaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgccgggccgaugcccgucacgguggcgagcgccgcccagcgccggggccgcaucggccggaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgucagcggcgaccugauccucgagaucggcaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcggugcucaccggcggggucacccuguucuuccugagcgggaaggggcucggcaagaccuccaucgggcugcugugcgugaccgccagcuccgcccuccuguggauggccagcguggagccccacuggaucgccgcguccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggccgcggagaaccaccagcacgccacgaugcuggacguggaccugcggccggccagcgccuggacccucuacgccgucgcgaccaccgugaucacgcccaugaugcgccacaccaucgagaacaccaccgccaacaucucccugacggccaucgccaaccaggccgcgauccugaugggccucgacaagggcuggcccaucagcaagauggacaucggggugccccugcuggcccucggcugcuacucccaggucaacccgcugacccugaccgccgccgugcucaugcugguggcgcacuacgccaucaucgggcccggccugcaggccaaggccacccgggaggcccagaagcgcacggcggccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgguucaccauggcccaccgcaagcccaccuucgagcgcgacguggaccugggcgcgggcacgcggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcguggugcggcugcugaccaagcccugggacgucauccccauggugacgcagaucgcgaugaccgacaccaccccguucgggcagcagcgcgucuucaaggagaagguggacacgcggacgccccgggccaagcggggcaccacccagaucauggaggugacggccaaguggcucuggggcuuccugucccgcaacaagaagccccggaucugcacccgcgaggaguucacccggaagguccgcagcaacgccgccaucggggcgguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgccgacgacacggcggggugggacacccggaucaccgaggacgaccuccagaacgaggccaagaucaccgacaucauggagcccgagcacgcccugcuggccacgagcaucuucaagcucaccuaccagaacaagguggugcgcguccagcgccccgccaagaacggcaccgugauggacgugaucucccggcgcgaccagcgggggagcggccaggucggcaccuacgggcugaacacguucaccaacauggaggugcagcugauccgccagauggaguccgagggcaucuuccuccccagcgagcuggagaccccgaaccuggcggagcgggugcucgacuggcuggagaagcacggggccgagcgccugaagcggauggccaucuccggcgacgacugcgucgugaagcccaucgacgaccgcuucgccaccgcccucaccgcgcugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagacggccugccugggcaagagcuacgcccagauguggcagcucauguacuuccaccggcgcgaccugcggcuggcggccaacgccaucugcuccgccgugcccgucgacugggugcccaccagccgcaccaccuggagcauccacgcgcaccaccaguggaugacgaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccacgugggccaccaacauccaggucgccaucaaccaggugcggcgccugaucgggaacgagaacuaccuggacuacaugaccuccaugaagcgguucaagaacgagagcgaccccgagggcgcgcucugguga

SEQ ID NO: 8102 - RNA, 9879 nt, Artificial Sequence
  derived and/or modified CDS sequence (opt1) from DENV-1__KJ189319__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagccuggggugcaagccccucaccauguuccugaucacggagaacaagaucuggggccggaaguccuggccccugaacgaggggaucauggccaucggcaucgucagcauccuccuguccagccugcucaagaacgacgugccccuggccgggccgcugaucgccggcggcaugcucaucgccugcuacgugaucagcggguccagcgcggaccugucccuggagaaggccgccgaggucagcugggagcaggaggccgagcacuccggcaccagccacaacauccucguggaggugcaggacgacgggaccaugaagaucaaggacgaggagcgcgacgacacccugacgauccugcucaaggccacccugcuggcggucuccggcguguaccccaugagcauccccgccacccucuucgugugguacuucuggcagaagaagaagcagcgguccgggguccugugggacacccccagcccgcccgagguggagcgcgccgugcuggacgacggcaucuaccggauccugcagcgcggccuccuggggcggucccaggucggcguggggguguuccaggacggcgucuuccacacgauguggcacgugacccgcggggccgugcugauguaccagggcaagcggcucgagcccagcugggccuccgucaagaaggaccugaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccucuacgggaacggcguggucacgaccagcgggaccuacguguccgccaucgcccaggcgaaggccagccaggagggcccccugcccgagaucgaggacgagguguucaagaagcgcaaccugaccaucauggaccuccacccggggagcggcaagacgcggcgcuaccugcccgccaucguccgggaggccaucaagcgcaagcugcggacccucauccuggcgcccacccgcgugguggccuccgagauggccgaggcccugaagggcaugcccauccgcuaccagaccacggccgucaagagcgagcacaccgggcgggagaucguggaccucaugugccacgcgaccuucaccaugcgccugcuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccuccgcaagaacggcaagcgggucauccagcugagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccucaaggacggccccgagcgggugauccuggcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcuccuggacaacaucaacacccccgaggggaucaucccggcccuguucgagcccgagcgcgagaaguccgccgccaucgacggcgaguaccgccuccgcggggaggcccgcaagaccuucgucgagcugaugcggcgcggcgaccugcccguguggcucagcuacaaggucgcguccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcccggaccuacuccgacccgcuggcccugcgcgaguucaaggaguucgccgccgggcggcgcagcgucagcggcgaccucauccuggagaucggcaagcugccccagcaccucacgcugcgggcgcagaacgcccuggacaaccucgugaugcugcacaacuccgagcagggcgggaaggccuaccgccacgccauggaggagcugcccgacaccaucgagacccucaugcugcuggcgcucaucgccgugcugaccgggggcgucacgcuguucuuccucagcgggaagggccugggcaagaccuccaucgggcugcucugcgugaccgccagcuccgcccugcuguggauggccagcguggagccccacuggaucgcggccuccaucauccucgaguucuuccugaugguccugcucaucccggagcccgaccggcagcgcacgccccaggacaaccagcuggccuacguggugaucggccuccucuucaugauccugacggucgccgccaacgagauggggcugcucgagaccaccaagaaggaccugggcaucgggcacguggcggccgagaaccaccagcacgccaccaugcuggacguggaccuccggccggccagcgccuggacgcuguacgcggucgccaccaccgugaucacccccaugaugcgccacacgaucgagaacaccaccgccaacaucucccugaccgccaucgccaaccaggcggccauccucaugggccuggacaagggcuggcccaucagcaagauggacaucggggugccccugcucgcccugggcugcuacucccaggucaacccgcugacgcucaccgccgcggugcugaugcugguggcccacuacgccaucaucgggcccggccuccaggccaaggccacccgggaggcgcagaagcgcaccgccgccgggaucaugaagaaccccacggucgacggcaucguggccaucgaccuggaccccguggucuacgacgccaaguucgagaagcagcugggccagaucaugcuccugauccugugcaccagccagauccuccugaugcgcaccaccugggcgcugugcgaguccaucacgcucgccaccgggccgcugaccacccugugggagggcagccccgggaaguucuggaacacgaccaucgccguguccauggccaacaucuuccggggcagcuaccucgccggcgcggggcuggccuucucccugaugaagucccucggcgggggccgccgggggaccggcgcccagggcgagacccugggggagaaguggaagcgccagcugaaccagcucuccaagagcgaguucaacacguacaagcggagcggcaucauggagguggaccgcuccgaggccaaggaggggcugaagcggggcgagaccaccaagcacgcggucagccgcgggaccgccaagcugcggugguucguggagcgcaaccuggugaagcccgagggcaaggucaucgaccucggcugcgggcggggcgggugguccuacuacugcgccggccugaagaaggugaccgaggugaagggguacacgaagggcggccccgggcacgaggagccgauccccauggccaccuacggcuggaaccuggucaagcuccacagcgggaaggacguguucuucaugccgcccgagaagugcgacacccugcugugcgacaucggcgaguccagcccgaaccccaccaucgaggaggggcgcacgcuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacccacgagauguacugggugagcugcggcaccgggaacaucguguccgccgucaacaugacgagccgcaugcugcugaaccgguucaccauggcgcaccgcaagcccaccuucgagcgcgacguggaccucggcgccggcacccggcacguggccgucgagcccgagguggccaaccuggacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcucaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcuguggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgcggacgacaccgccgggugggacacgcggaucaccgaggacgaccugcagaacgaggccaagaucaccgacaucauggagcccgagcacgcccugcucgccaccagcaucuucaagcugacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcucauccgccagauggaguccgagggcaucuuccugcccagcgagcuggagaccccgaaccucgccgagcgggugcuggacuggcuggagaagcacggggccgagcgccucaagcggauggccaucuccggcgacgacugcgucgugaagcccaucgacgaccgcuucgccaccgcgcugaccgcccugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagaccgccugccucggcaagagcuacgcgcagauguggcagcugauguacuuccaccggcgcgaccugcggcucgccgccaacgccaucugcuccgcggugcccgucgacugggugcccacgagccgcaccaccuggagcauccacgcccaccaccaguggaugaccacggaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgcgccaccugggccacgaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8103 - RNA, 9879 nt, Artificial Sequence
  derived and/or modified CDS sequence (opt1) from DENV-1__KJ189320__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucaccgagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgguucaccauggcgcaccgcaagcccaccuucgagcgcgacguggaccugggcgccggcacgcggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggucaacggcguggugcggcugcugaccaagcccugggacgucauccccauggugacgcagaucgccaugaccgacaccaccccguucgggcagcagcgcgucuucaaggagaagguggacacgcggacgccccgggccaagcggggcaccacccagaucauggaggugacggccaaguggcucuggggcuuccugucccgcaacaagaagccccggaucugcacccgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacacggccgggugggacacccggaucaccgaggacgaccuccagaacgaggccaagaucaccgacaucauggagcccgagcacgcccugcuggccacgagcaucuucaagcucaccuaccagaacaagguggugcgcguccagcgccccgcgaagaacggcaccgugauggacgugaucucccggcgcgaccagcgggggagcggccaggucggcaccuacgggcugaacacguucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagacggccugccugggcaagagcuacgcgcagauguggcagcucauguacuuccaccggcgcgaccugcggcuggccgccaacgccaucugcuccgcggugcccgucgacugggugcccaccagccgcaccaccuggagcauccacgcccaccaccaguggaugacgaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccacgugggccaccaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8104 - RNA, 9879 nt, Artificial Sequence
  derived and/or modified CDS sequence (opt1) from DENV-1__KJ189323__SS-prME
agcgugaccaugcugcucaugcugcugcccaccgcccucgccuuccaccugaccacccggggcggggagccccacaugaucguguccaagcaggagcggggcaagagccugcuguucaagaccuccgccggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggcccuucaagcuggagaaggaggucgcggagacgcagcacggcaccgugcuggugcaggucaaguacgagggcaccgacgcccccugcaagaucccguucagcacccaggacgagaagggggugacgcagaacggccgccucaucaccgccaaccccaucgugaccgacaaggagaagcccgucaacaucgagaccgagcccccguucggggaguccuacaucguggugggcgccggcgagaaggcgcugaagcugagcugguucaagaagggguccagcaucggcaagauguucgaggccacggcccgcggggcccgccggauggccauccucggcgacaccgcgugggacuucggguccaucggcggcgucuucaccagcguggggaagcuggugcaccaggucuucggcaccgccuacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgcgagcugaagugcgggagcggcaucuucgugaccaacgagguccacaccuggaccgagcaguacaaguuccaggccgacucccccaagcggcugagcgcggccaucggcaaggccugggaggagggggugugcggcauccgcagcgccacccggcucgagaacaucauguggaagcagaucuccaacgagcugaaccacauccugcucgagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggccggacacccccgagugccccgacaaccagcgggccuggaacaucugggagguggaggacuacggcuucgggaucuucacgaccaacaucuggcugaagcuccgcgacagcuacacccagaugugcgaccaccggcugauguccgcggccaucaaggacagcaaggccguccacgccgacaugggcuacuggaucgaguccgagaagaacgagaccuggaagcuggcccgcgcgagcuucaucgaggugaagacgugcaccuggcccaagucccacacccucuggagcaacggcgugcuggaguccgagaugaucaucccgaagaucuacgggggccccaucagccagcacaacuaccggcccggguacuucacccagacggccggcccguggcaccuggggaagcucgagcuggacuucgaccugugcgagggcaccaccgucgugguggacgagcacugcggcaaccgcgggcccucccuccggaccacgaccgucaccggcaagaucauccacgaguggugcugccgcagcugcacccugccgccccugcgguuccgcggggaggacggcugcugguacgggauggagauccggccggugaaggagaaggaggagaaccucgugcgcuccauggucagcgccggcuccggcgagguggacagcuucagccuggggauccugugcguguccaucaugaucgaggaggucaugcggagccgcuggucccggaagaugcucaugacgggcacccuggccguguuccugcuccuggugauggggcagcugaccuggaacgaccucauccgccugugcaucauggucggcgccaacgcgagcgaccgcauggggaugggcaccacguaccuggcccucauggccaccuucaagaugcggcccauguucgccgugggccugcuguuccgccggcucaccucccgcgaggugcugcugcucaccaucgggcugagccuggucgccuccguggagcuccccaacagccuggaggagcugggcgacgggcucgcgaugggcaucaugaugcugaagcugcucacggaguuccagccccaccagcuguggaccacccugcucucccugaccuucaucaagacgacccugagccucgacuacgccuggaagaccaccgccauggcccuguccaucgucagccuguucccgcucugccuguccacgaccagccagaagaccaccuggcugcccgugcuccugggcuccuucgggugcaagccccugaccauguuccucaucacggagaacaagaucuggggccgcaagagcuggccccugaacgaggggaucauggcgaucggcaucguguccauccugcucagcucccugcugaagaacgacgucccgcucgccgggccccugaucgccggcggcaugcugaucgccugcuacgugaucagcgggagcuccgccgaccucagccuggagaaggcggccgagguguccugggagcaggaggccgagcacagcggcaccucccacaacauccuggucgaggugcaggacgacgggaccaugaagaucaaggacgaggagcgggacgacacccucacgauccugcugaaggccacccuccuggccgugagcggcgucuaccccauguccauccccgcgacccuguucgugugguacuucuggcagaagaagaagcagcggagcggggugcucugggacaccccgagcccgcccgaggucgagcgcgccgugcuggacgacggcaucuaccggauccugcagcgcggccugcucgggcggagccaggugggcgucgggguguuccagggcgggguguuccacacgauguggcacgucacccgcggcgccgugcugauguaccagggcaagcggcuggagcccuccugggccagcgugaagaaggaccucaucuccuacgggggcggguggcgcuuccagggcagcuggaacaccggggaggagguccaggugaucgccguggagccgggcaagaaccccaagaacguccagaccacgcccggcaccuucaagacccccgagggggaggugggcgcgaucgcccuggacuucaagccggggaccuccggcagccccaucgugaaccgggagggcaagaucgucgggcuguacggcaacgggguggugacgaccuccggcaccuacgucagcgccaucgcccaggccaaggcgucccaggaggggccccucccggagaucgaggacgagguguucaagaagcgcaaccugaccaucauggaccugcaccccggcagcggcaagacgcggcgcuaccuccccgccaucgugcgggaggccaucaagcgcaagcugcggacccugauccucgcccccacccgcgucguggcgagcgagauggccgaggcccugaaggggaugccgauccgcuaccagaccacggccgugaaguccgagcacaccggccgggagaucgucgaccugaugugccacgccaccuucaccaugcgccuccugagccccgugcgggugcccaacuacaacaugaucaucauggacgaggcgcacuucacggaccccgccuccaucgccgcccgcggguacaucagcacccgggucggcaugggggaggccgcggccaucuucaugaccgccaccccgcccggcuccguggaggccuucccccagagcaacgccgugauccaggacgaggagcgcgacauccccgagcgguccuggaacagcggcuacgacuggaucacggacuucccggggaagaccgucugguucgugcccuccaucaagagcggcaacgacaucgcgaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggccgaccgcgugaucgacccccggcgcugccugaagcccgucauccugaaggacgggccggagcgggugauccucgccggccccaugcccgugaccgucgcguccgccgcccagcgccggggccgcaucgggcggaaccagaacaaggagggcgaccaguacguguacauggggcagccccugaacaacgacgaggaccacgcccacuggacggaggccaagaugcugcucgacaacaucaacaccccggagggcaucauccccgcgcuguucgagcccgagcgcgagaaguccgccgccaucgacggggaguaccgccugcggggcgaggcccgcaagaccuucgucgagcucaugcggcgcggcgaccugcccguguggcuguccuacaagguggccagcgagggguuccaguacuccgaccggcgcuggugcuucgacggcgagcggaacaaccagguccucgaggagaacauggacguggagaucuggaccaaggagggggagcgcaagaagcugcggccgcgcuggcuggacgcgcggaccuacagcgacccccucgcccugcgcgaguucaaggaguucgccgccggccggcgcuccgugagcggcgaccugauccucgagaucgggaagcugccccagcaccugacgcuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccggcggggugacgcuguucuuccuguccggcaagggccucgggaagaccagcaucggccugcugugcgucaccgccuccagcgcccuccuguggauggccuccguggagccgcacuggaucgccgcgagcaucauccuggaguucuuccucauggugcugcugauccccgagcccgaccggcagcgcaccccgcaggacaaccagcucgccuacgucgugaucgggcugcuguucaugauccucacgguggccgccaacgagaugggccugcuggagaccaccaagaaggaccucgggaucggccacgucgccgcggagaaccaccagcacgccaccaugcuggacguggaccugcggcccgccuccgccuggacgcucuacgccguggcgaccaccgucaucacccccaugaugcgccacacgaucgagaacaccaccgccaacaucagccugaccgccaucgccaaccaggccgcgauccugaugggccucgacaagggguggcccaucuccaagauggacaucggcgugccgcugcuggcccucgggugcuacagccaggugaacccccugacgcugaccgccgccguccucaugcugguggcgcacuacgccaucaucggccccgggcugcaggccaaggccacccgggaggcccagaagcgcaccgcggccggcaucaugaagaaccccacgguggacggcaucgucgccaucgaccucgacccggugguguacgacgccaaguucgagaagcagcuggggcagaucaugcugcucauccugugcaccucccagauccugcucaugcgcaccaccugggcccugugcgagagcaucacgcuggcgaccggcccccucaccacccugugggaggggucccccggcaaguucuggaacacgaccaucgccgucagcauggccaacaucuuccggggcuccuaccuggccggggccggccucgcguucagccugaugaagucccucgggggcgggcgccgggggaccggcgcccagggggagacccucggcgagaaguggaagcgccagcugaaccagcugagcaaguccgaguucaacacguacaagcggagcgggaucauggagguggaccgcagcgaggccaaggagggccucaagcgcggggagaccaccaagcacgccgugucccgcggcaccgcgaagcugcggugguucgucgagcgcaaccuggugaagcccgagggcaaggugaucgaccuggggugcggccgcgggggcuggagcuacuacugcgccgggcucaagaaggucaccgaggugaagggcuacacgaagggcgggccgggccacgaggagcccauccccauggccaccuacggguggaaccuggugaagcugcacuccggcaaggacgucuucuucaugcccccggagaagugcgacacccuccugugcgacaucggggagagcucccccaaccccaccaucgaggagggccgcacgcugcgggugcucaagaugguggagcccuggcugcgcggcaaccaguucugcaucaagauccugaacccguacaugcccagcgucguggagacccucgagcagaugcagcggaagcacgggggcaugcuggugcgcaacccccugucccggaacagcacccacgagauguacugggucuccugcgggaccggcaacaucgugagcgccgugaacaugacgucccgcaugcuccugaaccgguucaccauggcccaccgcaagcccaccuacgagcgcgacgucgaccugggcgcggggacccggcacguggccguggagccggaggucgccaaccucgacaucaucggccagcgcaucgagaacaucaagaacgagcacaagagcacguggcacuacgacgaggacaaccccuacaagaccugggccuaccacggguccuacgaggugcggcccagcggcuccgccagcuccauggugaacggggucgugcgccugcugaccaagcccugggacgucaucccgauggugacccagaucgcgaugacggacaccacccccuucggccagcagcggguguucaaggagaaggucgacacccgcacgccccgggccaagcgcggcaccacccagaucauggaggugaccgccaaguggcucuggggguuccugagccggaacaagaagccgcgcaucugcacgcgggaggaguucacccgcaaggugcgguccaacgccgccaucggcgcggucuucguggacgagaaccaguggaacagcgccaaggaggccguggaggacgagcgcuucugggaccugguccaccgggagcgcgagcuccacaagcaggggaagugcgcgaccugcguguacaacaugaugggcaagcgggagaagaagcugggggaguucggcaaggcgaagggcagccgcgccaucugguacauguggcugggggcccgguuccucgaguucgaggcccugggcuucaugaacgaggaccacugguucucccgcgagaacagccuguccgggguggagggcgaggggcuccacaagcugggcuacauccugcgggacaucagcaagauccccggcgggaacauguacgccgacgacaccgcgggcugggacacgcgcaucaccgaggacgaccuccagaacgaggccaagaucaccgagaucauggagcccgagcacgcccugcuggccaccuccaucuucaagcucacguaccagaacaaggucgugcgcgugcagcggcccgccaagaacgggaccgucauggacgugaucagccgccgggaccagcgcggcuccggccagguggggaccuacggccugaacaccuucacgaacauggagguccagcugauccggcagauggagagcgaggggaucuuccucccguccgagcuggagacccccaaccuggcggagcgcgugcucgacuggcuggagaagcacggcgccgagcggcugaagcgcauggccaucagcggggacgacugcguggucaagcccaucgacgaccgguucgccaccgcccucaccgcgcugaacgacaugggcaaggugcgcaaggacaucccccagugggagccguccaagggcuggaacgacuggcagcagguccccuucugcagccaccacuuccaccagcugaucaugaaggacgggcgggagaucgucgugcccugccgcaaccaggacgagcucgugggccgggcccgcgucucccagggggccggcuggagccugcgggagaccgccugccuggggaaguccuacgcccagauguggcagcucauguacuuccaccgccgggaccugcgccuggcggccaacgccaucugcagcgccgugcccguggacugggucccgacgucccggaccaccuggagcauccacgcgcaccaccaguggaugaccacggaggacaugcucagcguguggaaccgcguguggaucgaggagaaccccuggauggaggacaagacccacgucuccagcugggaggaggugcccuaccugggcaagcgcgaggaccaguggugcggcucccugaucgggcucaccgcccgggccaccugggccacgaacauccagguggccaucaaccagguccgccggcugaucggcaacgagaacuaccuggacuacaugaccagcaugaagcgcuucaagaacgaguccgaccccgagggggcgcucugguga

SEQ ID NO: 8105 - RNA, 9879 nt, Artificial Sequence
  derived and/or modified CDS sequence (opt1) from DENV-1__KJ189324__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggggagcucugcgaggacaccaugaccuacaagugcccccagaucaccgaggccgagcccgacgacguggacugcuggugcaacgccaccgacaccugggugaccuacgggaccugcagccagaccggggagcaccggcgggacaagcgcuccguggcccuggcgccccacgugggccuggggcucgagacgcggaccgagaccuggaugagcuccgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggccccggagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucuccgccggcagcggcgagguggacagcuucucccuggggauccugugcgccagcaucaugaucgaggaggugaugcgcucccgguggagccgcaagaugcucaugacgggcacccuggccgucuuccugcuccuggugauggggcagcugaccuggaacgaccucauccgccugugcaucauggugggcgcgaacgccuccgaccggauggggaugggcaccacguaccuggcccucauggccaccuucaagaugcgcccgauguucgccgucggccugcuguuccggcgccucaccagccgggaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccgcaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgggacgacacccucacgauccugcugaaggccacccuccuggcgguguccggcguguaccccaugagcauccccgccacccuguucgucugguacuucuggcagaagaagaagcagcgcuccggggugcucugggacacccccagcccgcccgagguggagcgggccguccuggacgacggcaucuaccgcauccugcagcggggccugcucgggcgcucccaggugggcgugggggucuuccaggacggcguguuccacacgauguggcacgugacccgcggggccguccugauguaccagggcaagcgccuggagcccagcugggccuccgugaagaaggaccucaucagcuacggcgggggcuggcgguuccagggguccuggaacaccggcgaggaggugcaggucaucgcgguggagcccgggaagaacccgaagaacgugcagaccacgcccggcaccuucaagacccccgagggcgaggucggggccaucgcccuggacuucaagcccggcaccagcggguccccgaucgugaaccgcgagggcaagaucgugggccuguacgggaacggcgucgugacgaccagcgggaccuacguguccgccaucgcccaggcgaaggccagccaggagggcccccuccccgagaucgaggacgaggucuucaagaagcggaaccugaccaucauggaccugcacccggggagcggcaagacgcgccgguaccuccccgccaucgugcgcgaggccaucaagcggaagcugcgcacccugauccucgcgcccacccgcguggucgccuccgagauggccgaggcccugaagggcaugcccauccgguaccagaccacggccgucaagagcgagcacaccgggcgcgagaucguggaccugaugugccacgcgaccuucaccaugcggcuccuguccccgguccgcgugcccaacuacaacaugaucaucauggacgaggcccacuucacggaccccgccagcaucgccgcccggggcuacaucuccacccgcguggggaugggcgaggcggccgccaucuucaugaccgccacgccgcccgggagcgucgaggccuucccccaguccaacgcggugauccaggacgaggagcgggacauccccgagcgcagcuggaacuccggcuacgacuggaucacggacuuccccggcaagaccgugugguucguccccagcaucaaguccgggaacgacaucgccaacugccugcggaagaacggcaagcgcgugauccagcucagccggaagaccuucgacaccgaguaccagaagacgaagaacaacgacugggacuacguggucaccaccgacaucuccgagaugggggccaacuuccgcgccgaccgggugaucgacccccgccggugccugaagcccgugauccugaaggacggccccgagcgcgucauccucgcggggccgaugcccgugaccguggccagcgccgcccagcggcgcggccggaucggccgcaaccagaacaaggagggggaccaguacgucuacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccggcugcgcggggaggcccggaagaccuucguggagcucaugcgccggggcgaccugcccgucuggcugagcuacaagguggcguccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcaccuacuccgacccgcucgcccugcgggaguucaaggaguucgccgccgggcgccggagcgugagcggcgaccugauccucgagaucggcaagcugccccagcaccugacgcuccgcgcgcagaacgcccuggacaaccuggugaugcuccacaacuccgagcagggcgggaaggccuaccggcacgccauggaggagcugcccgacaccaucgagacccugaugcuccuggcgcugaucgccguccucaccgggggcgugacgcuguucuuccugagcgggaagggccucggcaagaccuccaucgggcugcugugcgugaccgccagcuccgcccuccuguggauggccagcgucgagccccacuggaucgcggccuccaucauccuggaguucuuccucauggugcugcugaucccggagcccgaccgccagcggacgccccaggacaaccagcucgccuacguggucaucggccugcuguucaugauccucacgguggccgccaacgagauggggcugcuggagaccaccaagaaggaccucggcaucgggcacguggcggccgagaaccaccagcacgccaccaugcuggacgucgaccugcgcccggccagcgccuggacgcucuacgcgguggccaccaccgugaucacccccaugaugcggcacacgaucgagaacaccaccgccaacaucucccugaccgccaucgccaaccaggcggccauccugaugggccucgacaagggcuggcccaucagcaagauggacaucggggucccccugcuggcccucggcugcuacucccaggugaacccgcugacgcugaccgccgcggugcucaugcuggucgcccacuacgccaucaucgggcccggccugcaggccaaggccacccgcgaggcgcagaagcgcaccgccgccgggaucaugaagaaccccacgguggacggcaucguggccaucgaccucgaccccgucguguacgacgccaaguucgagaagcagcugggccagaucaugcugcucauccugugcaccagccagauccugcucaugcggaccaccugggcgcugugcgaguccaucacgcuggccaccgggccgcucaccacccugugggagggcagccccgggaaguucuggaacacgaccaucgccguguccauggccaacaucuuccgcggcagcuaccuggccggcgcggggcucgccuucucccugaugaagucccugggcgggggccggcgcgggaccggcgcccagggcgagacccucggggagaaguggaagcggcagcugaaccagcuguccaagagcgaguucaacacguacaagcgcagcggcaucauggaggucgaccgguccgaggccaaggaggggcucaagcgcggcgagaccaccaagcacgcggugagccgggggaccgccaagcugcgcugguucguggagcggaaccuggucaagcccgagggcaaggugaucgaccugggcugcgggcgcggcgggugguccuacuacugcgccggccucaagaaggugaccgaggucaagggguacacgaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccaccaucgaggaggggcggacgcugcgcguccucaagaugguggagcccuggcugcggggcaaccaguucugcaucaagauccugaaccccuacaugccguccguggucgagacccucgagcagaugcagcgcaagcacggcgggaugcuggugcggaacccccugagccgcaacuccacccacgagauguacugggugagcugcggcaccgggaacaucgucuccgccgugaacaugacgagccggaugcuccugaaccgcuucaccauggcgcaccgcaagcccaccuacgagcgggacguggaccugggcgccggcacccgccacgucgccguggagcccgagguggccaaccucgacaucaucgggcagcggaucgagaacaucaagaacgagcacaaguccacguggcacuacgacgaggacaacccguacaagaccugggccuaccacggcagcuacgaggucaagcccuccgggagcgcguccagcauggugaacggcgugguccgccugcugaccaagcccugggacgugauccccauggucacccagaucgccaugacggacaccaccccguucgggcagcagcggguguucaaggagaagguggacacccgcacgccccgggccaagcgcggcaccacccagaucauggaggucaccgccaaguggcucuggggcuuccugucccggaacaagaagccccgcaucugcacgcgggaggaguucacccgcaaggugcggagcaacgccgcgaucggggccguguucgucgacgagaaccaguggaacagcgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgcggacgacaccgccgggugggacacgcgcaucaccgaggacgaccuccagaacgaggccaagaucaccgagaucauggagcccgagcacgcccugcuggccaccagcaucuucaagcucacguaccagaacaaggugguccgcgugcagcggcccgcgaagaacggcaccgugauggacgucaucucccgccgggaccagcgcgggagcggccaggugggcaccuacgggcugaacaccuucacgaacauggaggugcagcugauccggcagauggaguccgaggagaucuuccuccccagcgagcuggagaccccgaaccuggccgagcgcguccucgacuggcuggagaagcacggcgccgagcggcugaagcgcauggccaucuccggggacgacugcguggugaagcccaucgacgaccgguucgccaccgcgcucaccgcccugaacgacaugggcaagguccgcaaggacaucccccagugggagcccagcaagggguggaacgacuggcagcaggucccguucugcucccaccacuuccaccagcugaucaugaaggacggccgggagaucgugguccccugccgcaaccaggacgagcucgugggccgggcccgcgugagccagggggccggcuggucccugcgggagaccgccugccugggcaagagcuacgcgcagauguggcagcucauguacuuccaccgccgggaccugcgccuggccgccaacgccaucugcuccgcgguccccguggacugggugcccacgagccggaccaccuggagcauccacgcccaccaccaguggaugaccacggaggacaugcucuccgucuggaaccgcguguggaucgaggagaacccguggauggaggacaagacccacgugagcuccugggaggagguccccuaccugggcaagcgcgaggaccaguggugcgggagccugaucggccucaccgcccgggccaccugggccacgaacauccagguggcgaucaaccaggugcgccggcugaucggcaacgagaacuaccuggacuacaugaccuccaugaagcgcuucaagaacgagagcgaccccgagggggcccucugguga

SEQ ID NO: 8106 - RNA, 9879 nt, Artificial Sequence
  derived and/or modified CDS sequence (opt1) from DENV-1__KJ189325__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaccaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugcccgacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccuggugauggggcagcugaccuggaacgaccucauccgccugugcaucauggugggcgcgaacgccuccgaccgcauggggaugggcacgaccuaccuggcccucauggccaccuucaagaugcggccgauguucgccgucgggcugcuguuccgccggcucaccagccgcgaggugcugcugcucacgaucgggcugucccugguggcgagcgucgagcuccccaacucccuggaggagcugggcgacgggcucgccaugggcaucaugaugcugaagcugcucaccgaguuccagccccaccagcuguggaucacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacccucacgauccugcugaaggccacccuccuggcgguguccggcguguaccccaugagcauccccgccacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgcgguggagcccgggaagaacccgaagaacgugcagaccaugcccggcacguucaagacccccgagggcgaggucggggccaucgcccuggacuucaagcccggcaccagcggguccccgaucgugaaccgggagggcaagaucgugggccuguacgggaacggcgucgugaccacgagcgggaccuacguguccgccaucgcccaggcgaaggccagccaggagggcccccuccccgagaucgaggacgaggucuucaagaagcgcaaccugaccaucauggaccugcacccggggagcggcaagacccggcgcuaccuccccgccauggugcgggaggccaucaagcgcaagcugcggacgcugauccucgcgcccacccgcguggucgccuccgagauggccgaggcccugaagggcaugcccauccgcuaccagaccaccgccgucaagagcgagcacacggggcgggagaucguggaccugaugugccacgcgaccuucaccaugcgccuccuguccccgguccgggugcccaacuacaacaugaucaucauggacgaggcccacuucaccgaccccgccagcaucgccgcccgcggcuacaucuccacgcggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucaccgacuuccccggcaagacggugugguucguccccagcaucaaguccgggaacgacaucgccaacugccugcgcaagaacggcaagcgggugauccagcucagccgcaagaccuucgacaccgaguaccagaagaccaagaacaacgacugggacuacguggucacgaccgacaucuccgagaugggggccaacuuccgggccgaccgcgugaucgacccccggcgcugccugaagcccgugauccugaaggacggccccgagcgggucauccucgcggggccgaugcccgugaccguggccagcgccgcccagcgccggggccgcaucggccggaaccagaacaaggagggggaccaguacgucuacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacacgaucgagacccugaugcuccuggcgcugaucgccguccucaccgggggcgugacccuguucuuccugagcgggaagggccucggcaagacguccaucgggcugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagacgaccaagaaggaccucggcaucgggcacguggcggccgagaaccaccagcacgccaccaugcuggacgucgaccugcggccggccagcgccuggacccucuacgcgguggccacgaccgugaucacccccaugaugcgccacaccaucgagaacacgaccgccaacaucucccugaccgccaucgccaaccaggcggccauccugaugggccucgacaagggcuggcccaucagcaagauggacaucggggucccccugcuggcccucggcugcuacucccaggugaacccgcugacccugacggccgcggugcucaugcuggucgcccacuacgccaucaucgggcccggccugcaggccaaggccacccgggaggcgcagaagcgcaccgccgccgggaucaugaagaaccccaccguggacggcaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacggggccgcucaccacccugugggagggcagccccgggaaguucuggaacaccacgaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacaccuacaagcggagcggcaucauggaggucgaccgcuccgaggccaaggaggggcucaagcggggcgagacgaccaagcacgcggugagccgcgggaccgccaagcugcggugguucguggagcgcaaccuggucaagcccgagggcaaggugaucgaccugggcugcgggcggggcgggugguccuacuacugcgccggccucaagaaggugaccgaggucaagggguacaccaagggcggccccgggcacgaggagccgauccccauggccacguacggcuggaaccuggugaagcugcacagcgggaaggacguguucuucaugccgcccgagaagugcgacacccuccugugcgacaucggcgaguccagcccgaaccccaccaucgaggaggggcgcacccugcggguccucaagaugguggagcccuggcugcgcggcaaccaguucugcaucaagauccugaaccccuacaugccguccguggucgagacgcucgagcagaugcagcggaagcacggcgggaugcuggugcgcaacccccugagccggaacuccacccacgagauguacugggugagcugcggcaccgggaacaucgucuccgccgugaacaugaccagccgcaugcuccugaaccgguucacgauggcgcaccgcaagcccaccuacgagcgcgacguggaccugggcgccggcacccggcacgucgccguggagcccgagguggccaaccucgacaucaucgggcagcgcaucgagaacaucaagaacgagcacaaguccaccuggcacuacgacgaggacaacccguacaagacgugggccuaccacggcagcuacgaggucaagcccuccgggagcgcguccagcauggugaacggcgugguccggcugcugaccaagcccugggacgugauccccauggucacccagaucgccaugaccgacacgaccccguucgggcagcagcgcguguucaaggagaagguggacacccggacgccccgggccaagcggggcacgacccagaucauggaggucaccgccaaguggcucuggggcuuccugucccgcaacaagaagccccggaucugcacccgcgaggaguucacgcggaaggugcgcagcaacgccgcgaucggggccguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggugguccgcgugcagcgccccgcgaagaacggcacggugauggacgucaucucccggcgcgaccagcgggggagcggccaggugggcaccuacgggcugaacaccuucaccaacauggaggugcagcugauccgccagauggaguccgagggcaucuuccuccccagcgagcuggagacgccgaaccuggccgagcggguccucgacuggcuggagaagcacggggccgagcgccugaagcggauggccaucuccggcgacgacugcguggugaagcccaucgacgaccgcuucgccaccgcgcucaccgcccugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcgguccccguggacugggugcccaccagccgcacgaccuggagcauccacgcccaccaccaguggaugaccaccgaggacaugcucuccgucuggaaccggguguggaucgaggagaacccguggauggaggacaagacgcacgugagcuccugggaggagguccccuaccuggggaagcgcgaggaccaguggugcggcagccugaucggccucaccgcccgcgccaccugggccaccaacauccagguggcgaucaaccaggugcggcgccugaucgggaacgagaacuaccuggacuacaugacguccaugaagcgguucaagaacgagagcgaccccgagggcgcccucugguga

SEQ ID NO: 8107 - RNA, 9879 nt, Artificial Sequence
  derived and/or modified CDS sequence (opt1) from DENV-1__KJ189326__SS-prME
agcgugaccaugcugcucaugcugcugcccaccgcccucgccuuccaccugacgacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaccaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugccccacccagggcgaggccacccugguggaggagcaggacgccaacuucgugugccgccggacguucgucgaccgcggcugggggaacggcugcggccuguucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccuggugauggggcagcugaccuggaacgaccucauccgccugugcaucauggugggcgcgaacgccuccgaccgcauggggaugggcacgaccuaccuggcccucauggccaccuucaagaugcggccgauguucgccgucggccugcuguuccgccggcucaccagccgcgaggugcugcugcucacgaucgggcugucccugguggcgagcgucgagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgugucccuguucccccucugccugagcaccaccucccagaagaccaccuggcugccgguccuccugggcagcuucgggugcaagccccugacgauguuccucaucaccgagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaaggccgccgaggugagcugggagcaggaggccgagcacuccggcaccagccacaacauccugguggagguccaggacgacgggaccaugaagaucaaggacgaggagcgcgacgacacgcucaccauccugcugaaggccacccuccuggcgguguccggcguguaccccaugagcauccccgccacccuguucgucugguacuucuggcagaagaagaagcagcgguccggggugcucugggacacgcccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccaggggcuguggaacaccggcgaggaggugcaggucaucgcgguggagcccgggaagaacccgaagaacgugcagacgacccccggcaccuucaagacccccgagggcgaggucggggccaucgcccuggacuucaagcccggcacguccgggagcccgaucgugaaccgggagggcaagaucgugggccucuacgggaacggcgucgugaccaccuccgggaccuacgugagcgccaucgcccaggcgaaggccucccaggagggcccccugcccgagaucgaggacgaggucuucaagaagcgcaaccugacgaucauggaccuccacccggggagcggcaagacccggcgcuaccugcccgccauggugcgggaggccaucaagcgcaagcugcggacccucauccuggcgcccacccgcguggucgccagcgagauggccgaggcccugaagggcaugcccauccgcuaccagacgaccgccgugaaguccgagcacaccgggcgggagaucguggaccucaugugccacgcgaccuucacgaugcgccugcugagcccgguccgggugcccaacuacaacaugaucaucauggacgaggcccacuucaccgaccccgccuccaucgccgcccgcggcuacaucagcacccggguggggaugggcgaggcggccgccaucuucaugaccgccacgcccccgggguccgucgaggccuucccccagagcaacgcggugauccaggacgaggagcgcgacauccccgagcgguccuggaacagcggcuacgacuggaucaccgacuuccccggcaagaccgugugguucgucccguccaucaagagcgggaacgacaucgccaacugccuccgcaagaacggcaagcgggugauccagcugucccgcaagaccuucgacacggaguaccagaagaccaagaacaacgacugggacuacguggucaccaccgacaucagcgagaugggggccaacuuccgggccgaccgcgugaucgacccccggcgcugccugaagcccgugauccucaaggacggccccgagcgggucauccuggcggggccgaugcccgugacgguggccuccgccgcccagcgccggggccgcaucggccggaaccagaacaaggagggggaccaguacgucuacaugggccagccccugaacaacgacgaggaccacgcccacuggaccgaggcgaagaugcuccuggacaacaucaacacccccgaggggaucaucccggcccuguucgagcccgagcgcgagaaguccgccgccaucgacggcgaguaccgccuccgcggggaggcccgcaagaccuucguggagcugaugcggcgcggcgaccugcccgucuggcucuccuacaagguggcgagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcccggacguacagcgacccgcuggcccugcgcgaguucaaggaguucgccgccgggcggcgcuccgugagcggcgaccucauccuggagaucggcaagcugccccagcaccucacccugcgggcgcagaacgcccuggacaaccucgugaugcugcacaacagcgagcagggcgggaaggccuaccgccacgccauggaggagcugcccgacaccaucgagacccucaugcugcuggcgcucaucgccguccugaccggcggggugacccuguucuuccucuccgggaaggggcugggcaagaccagcaucgggcugcucugcgugaccgccuccagcgcccugcuguggauggccuccgucgagccccacuggaucgcggccagcaucauccucgaguucuuccugauggugcugcucaucccggagcccgaccggcagcgcacgccccaggacaaccagcuggccuacguggucaucggccuccucuucaugauccugaccguggccgccaacgagauggggcugcucgagaccaccaagaaggaccugggcaucgggcacguggcggccgagaaccaccagcacgccacgaugcuggacgucgaccuccggccggccuccgccuggacccuguacgcgguggccaccaccgugaucacgcccaugaugcgccacaccaucgagaacaccaccgccaacaucagccugacggccaucgccaaccaggcggccauccucaugggccuggacaagggcuggcccaucuccaagauggacaucggggucccccugcucgcccugggcugcuacagccaggugaacccgcugacccucaccgccgcggugcugaugcuggucgcccacuacgccaucaucgggcccggccuccaggccaaggccacccgggaggcgcagaagcgcacggccgccgggaucaugaagaaccccaccguggacggcaucguggccaucgaccuggaccccgucguguacgacgccaaguucgagaagcagcugggccagaucaugcuccugauccugugcaccucccagauccuccugaugcgcaccacgugggcgcugugcgagagcaucacccucgccaccgggccgcugaccacgcugugggagggcucccccgggaaguucuggaacaccaccaucgccgugagcauggccaacaucuuccggggcuccuaccucgccggcgcggggcuggccuucagccugaugaagucccucggcgggggccgccgggggaccggcgcccagggcgagacgcugggggagaaguggaagcgccagcugaaccagcucagcaaguccgaguucaacaccuacaagcggagcggcaucauggaggucgaccgcagcgaggccaaggaggggcugaagcggggcgagaccaccaagcacgcggugucccgcgggaccgccaagcugcggugguucguggagcgcaaccuggucaagcccgagggcaaggugaucgaccucggcugcgggcggggcggguggagcuacuacugcgccggccugaagaaggugacggaggucaagggguacaccaagggcggccccgggcacgaggagccgauccccauggccaccuacggcuggaaccuggugaagcuccacuccgggaaggacguguucuucaugccgcccgagaagugcgacacccugcugugcgacaucggcgagagcuccccgaaccccacgaucgaggaggggcgcacccuccggguccugaagaugguggagcccuggcugcgcggcaaccaguucugcaucaagauccucaaccccuacaugccgagcguggucgagacccuggagcagaugcagcggaagcacggcgggaugcuggugcgcaacccccucucccggaacagcacccacgagauguacuggguguccugcggcacggggaacaucgucagcgccgugaacaugaccucccgcaugcugcugaaccgguucaccauggcgcaccgcaagcccaccuacgagcgcgacguggaccucggcgccggcacgcggcacgucgccguggagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgcgagcuccauggugaacggcgugguccggcugcucaccaagcccugggacgugauccccauggucacgcagaucgccaugaccgacaccaccccguucgggcagcagcgcguguucaaggagaagguggacacgcggacgccccgggccaagcggggcaccacccagaucauggaggucacggccaaguggcuguggggcuuccugagccgcaacaagaagccccggaucugcacccgcgaggaguucacccggaaggugcgcuccaacgccgcgaucggggccguguucgucgacgagaaccaguggaacagcgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagaucccgggcggcaacauguacgcggacgacacggccgggugggacacccggaucaccgaggacgaccugcagaacgaggccaagaucaccgagaucauggagcccgagcacgcccugcucgccacguccaucuucaagcugaccuaccagaacaaggugguccgcgugcagcgccccgcgaagaacggcaccgugauggacgucaucagccggcgcgaccagcggggguccggccaggugggcaccuacgggcugaacacguucaccaacauggaggugcagcucauccgccagauggagagcgagggcaucuuccugcccuccgagcuggagaccccgaaccucgccgagcggguccuggacuggcuggagaagcacggggccgagcgccucaagcggauggccaucagcggcgacgacugcguggugaagcccaucgacgaccgcuucgccaccgcgcugaccgcccugaacgacauggggaagguccggaaggacaucccccagugggagcccuccaagggcuggaacgacuggcagcaggucccguucugcagccaccacuuccaccagcucaucaugaaggacggccgcgagaucgugguccccugccggaaccaggacgagcugguggggcgcgcccgggugucccagggcgccggguggagccugcgcgagacggccugccucggcaaguccuacgcgcagauguggcagcugauguacuuccaccggcgcgaccugcggcucgccgccaacgccaucugcagcgcgguccccguggacugggugcccaccucccgcaccaccuggagcauccacgcccaccaccaguggaugacgaccgaggacaugcugagcgucuggaaccggguguggaucgaggagaacccguggauggaggacaagacccacguguccagcugggaggagguccccuaccuggggaagcgcgaggaccaguggugcggcucccucaucggccugaccgcccgcgccacgugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 8108 - RNA, 9879 nt, Artificial Sequence
  derived and/or modified CDS sequence (opt1) from DENV-1__KJ189327__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccgccgggagaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacacccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccugaucauggggcagcugaccuggaacgaccucauccgccugugcaucauggugggcgcgaacgccuccgaccgcauggggaugggcacgaccuaccuggcccucauggccaccuucaagaugcggccgauguucgccgugggccugcuguuccgccggcucaccagccgcgagguccugcugcucacgaucgggcugucccugguggcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgucucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggcggucuccggcguguaccccaugagcauccccgccacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagacgacccccggcaccuucaagacccccgagggcgaggugggggccaucgcccuggacuucaagcccggcacgagcggguccccgaucgucaaccgggagggcaagaucgugggccuguacgggaacggcguggucaccaccagcgggaccuacguguccgccaucgcccaggcgaaggccagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcgcccacccgcgugguggccuccgagauggccgaggcccugaagggcaugcccauccgcuaccagacgaccgccgucaagagcgagcacaccgggcgggagaucguggaccugaugugccacgcgaccuucacgaugcgccuccuguccccggugcggguccccaacuacaacaugaucaucauggacgaggcccacuucaccgaccccgccagcaucgccgcccgcggcuacaucuccacccggguggggaugggcgaggcggccgccaucuucaugaccgccacgcccccggggagcguggaggccuucccccaguccaacgcggucauccaggacgaggagcgcgacauccccgagcggagcuggaacuccggcuacgacuggaucaccgacuuccccggcaagaccgugugguucgugccgagcaucaaguccgggaacgacaucgccaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucacgguggccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggacguacuccgacccgcucgcccugcgcgaguucaaggaguucgccgccgggcggcgcagcgucagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccggcggggucacccuguucuuccugagcgggaaggggcucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggcggccgagaaccaccagcacgccacgaugcuggacguggaccugcggccggccagcgccuggacccucuacgcggucgccaccaccgugaucacgcccaugaugcgccacaccaucgagaacaccaccgccaacaucucccugacggccaucgccaaccaggcggccauccugaugggccucgacaagggcuggcccaucagcaagauggacaucggggugccccugcuggcccucggcugcuacucccaggucaacccgcugacccugaccgccgcggugcucaugcugguggcccacuacgccaucaucgggcccggccugcaggccaaggccacccgggaggcgcagaagcgcacggccgccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcgcugugcgaguccaucacccuggccaccgggccgcucaccacgcugugggagggcagccccgggaaguucuggaacaccaccaucgccguguccauggccaacaucuuccggggcagcuaccuggccggcgcggggcucgccuucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgguucaccauggcgcaccgcaagcccaccuucgagcgcgacguggaccugggcgccggcacgcggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggucaacggcguggugcggcugcugaccaagcccugggacgucauccccauggugacgcagaucgccaugaccgacaccaccccguucgggcagcagcgcgucuucaaggagaagguggacacgcggacgccccgggccaagcggggcaccacccagaucauggaggugacggccaaguggcucuggggcuuccugucccgcaacaagaagccccggaucugcacccgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacacggccgggugggacacccggaucaccgaggacgaccuccagaacgaggccaagaucaccgacaucauggagcccgagcacgcccugcuggccacgagcaucuucaagcucaccuaccagaacaagguggugcgcguccagcgccccgcgaagaacggcaccgugauggacgugaucucccggcgcgaccagcgggggagcggccaggucggcaccuacgggcugaacacguucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagacggccugccugggcaagagcuacgcgcagauguggcagcucauguacuuccaccggcgcgaccugcggcuggccgccaacgccaucugcuccgcggugcccgucgacugggugcccaccagccgcaccaccuggagcauccacgcccaccaccaguggaugacgaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccacgugggccaccaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8109 - RNA, 9879 nt, Artificial Sequence
  derived and/or modified CDS sequence (opt1) from DENV-1__KJ189328__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggagaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccugaucauggggcagcugaccuggaaggaccucauccgccugugcaucauggugggcgccaacgcguccgaccgcauggggaugggcaccacguaccuggcccucauggccaccuucaagaugcggccgauguucgccgucgggcugcuguuccgccggcucaccagccgcgaggugcugcugcucaccaucgggcugucccugguggccagcgucgagcuccccaacucccuggaggagcugggcgacgggcucgcgaugggcaucaugaugcugaagcugcucacggaguuccacccccaccagcuguggaccacccugcucagccugaccuucaucaagacgacccugucccucgacuacgccuggaagaccaccgccauggcccugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcaccagccacaacauccugguggagguccaggacgacgggaccaugaagaucaaggacgaggagcgcgacgacacccucacgauccugcugaaggccacccuccuggccguguccggcguguaccccaugagcauccccgcgacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacgcccggcaccuucaagacccccgagggcgaggucggggcgaucgcccuggacuucaagcccggcaccagcggguccccgaucgugaaccgggagggcaagaucgugggccuguacgggaacggcgucgugacgaccagcgggaccuacguguccgccaucgcccaggccaaggcgagccaggagggcccccuccccgagaucgaggacgaggucuucaagaagcgcaaccugaccaucauggaccugcacccggggagcggcaagacgcggcgcuaccuccccgccaucgugcgggaggccaucaagcgcaagcugcggacccugauccucgcccccacccgcguggucgcguccgagauggccgaggcccugaagggcaugcccauccgcuaccagaccacggccgucaagagcgagcacaccgggcgggagaucguggaccugaugugccacgccaccuucaccaugcgccuccuguccccgguccgggugcccaacuacaacaugaucaucauggacgaggcgcacuucacggaccccgccagcaucgccgcccgcggcuacaucuccacccggguggggaugggcgaggccgcggccaucuucaugaccgccacgccgcccgggagcgucgaggccuucccccaguccaacgccgugauccaggacgaggagcgcgacauccccgagcggagcuggaacuccggcuacgacuggaucacggacuuccccggcaagaccgugugguucguccccagcaucaaguccgggaacgacaucgcgaacugccugcgcaagaacggcaagcgggugauccagcucagccgcaagaccuucgacaccgaguaccagaagacgaagaacaacgacugggacuacguggucaccaccgacaucuccgagaugggggccaacuuccgggccgaccgcgugaucgacccccggcgcugccugaagcccgugauccugaaggacggccccgagcgggucauccucgccgggccgaugcccgugaccguggcgagcgccgcccagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggugaugcuccacaacuccgagcagggcgggaaggccuaccgccacgccaucgaggagcugcccgacaccaucgagacccugaugcuccuggcccugaucgcgguccucaccgggggcgugacgcuguucuuccugagcgggaagggccucggcaagaccuccaucgggcugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucggccugcuguucaugauccucacgguggccgccaacgagauggggcugcuggagaccaccaagaaggaccucggcaucgggcacguggccgcggagaaccaccagcacgccaccaugcuggacgucgaccugcggccggccagcgccuggacgcucuacgccguggcgaccaccgugaucacccccaugaugcgccacacgaucgagaacaccaccgccaacaucucccugaccgccaucgccaaccaggccgcgauccugaugggccucgacaagggcuggcccaucagcaagauggacaucggggucccccugcuggcccucggcugcuacucccaggugaacccgcugacgcugaccgccgccgugcucaugcuggucgcgcacuacgccaucaucgggcccggccugcaggccaaggccacccgggaggcccagaagcgcaccgcggccgggaucaugaagaaccccacgguggacggcaucguggccaucgaccucgaccccgucguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccguguccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggaggucgaccgcuccgaggccaaggaggggcucaagcggggcgagaccaccaagcacgccgugagccgcgggaccgcgaagcugcggugguucguggagcgcaaccuggucaagcccgagggcaaggugaucgaccugggcugcgggcggggcgggugguccuacuacugcgccggccucaagaaggugaccgaggucaagggguacacgaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccaccaucgaggaggggcgcacgcugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacccacgagauguacugggugagcugcggcaccgggaacaucgucuccgccgugaacaugacgagccgcaugcuccugaaccgguucaccauggcccaccgcaagcccaccuacgagcgcgacguggaccugggcgcgggcacccggcacgucgccguggagcccgagguggccaaccucgacaucaucgggcagcgcaucgagaacaucaagaacgagcacaaguccacguggcacuacgacgaggacaacccguacaagaccugggccuaccacggcagcuacgaggucaagcccuccgggagcgccuccagcauggugaacggcgugguccggcugcugaccaagcccugggacgugauccccauggucacccagaucgcgaugacggacaccaccccguucgggcagcagcgcguguucaaggagaagguggacacccggacgccccgcgccaagcggggcaccacccagaucauggaggucaccgccaaguggcucuggggcuuccugucccgcaacaagaagccccggaucugcacgcgcgaggaguucacccggaaggugcgcagcaacgccgccaucggggcgguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaaggugguccgcgugcagcgccccgccaagaacggcaccgugauggacgucaucucccggcgcgaccagcgggggagcggccaggugggcaccuacgggcugaacaccuucacgaacauggaggugcagcugauccgccagauggaguccgagggcaucuuccuccccagcgagcuggagaccccgaaccuggcggagcggguccucgacuggcuggagaagcacggggccgagcgccugaagcggauggccaucuccggcgacgacugcguggugaagcccaucgacgaccgcuucgccaccgcccucaccgcgcugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugaaggagaccgccugccugggcaagagcuacgcccagauguggcagcucauguacuuccaccgccgggaccugcgccuggcggccaacgccaucugcuccgccguccccguggacugggugcccacgagccggaccaccuggagcauccacgcgcaccaccaguggaugaccacggaggacaugcucuccgucuggaaccgcguguggaucgaggagaacccguggauggaggacaagacccacgugagcuccugggaggagguccccuaccuggggaagcgggaggaccaguggugcggcagccugaucggccucaccgcccgcgccaccugggccacgaacauccagguggccaucaaccaggugcgccggcugaucgggaacgagaacuaccuggacuacaugaccuccaugaagcgcuucaagaacgagagcgaccccgagggcgcgcucugguga

SEQ ID NO: 8110 - RNA, 9879 nt, Artificial Sequence
  derived and/or modified CDS sequence (opt1) from DENV-1__KJ189329__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacgccugggucaccuacgggaccugcagccagaccggcgagcaccggcgggacaagcgcuccguggcgcuggcgccccacgugggccuggggcucgagacccggacggagaccuggaugagcuccgagggcgccuggaagcagauccagcgggucgagaccugggcccugcggcaccccggguucaccgugaucgccuucuuccuggcccacgccaucggcacgagcaucacccagaaggggaucaucuucauccuccugaugcuggugacccccuccauggccaugcgcugcgucggcaucggcaaccgggacuucguggaggggcucagcggcgccaccuggguggacgucgugcuggagcacggguccugcgugacgaccauggcgaagaacaagcccacccuggacaucgagcuccugaagaccgaggucacgaaccccgccauccugcgcaagcucugcaucgaggccaagaucagcaacaccaccaccgacucccggugcccgacgcagggcgaggccacccugguggaggagcaggacgccaacuucgugugccgccggaccuucgucgaccgcggcugggggaacggcugcgggcuguucggcaaggggagccuccugaccugcgcgaaguucaagugcgugacgaagcuggagggcaagaucgugcaguacgagaaccucaaguacuccgucaucgugaccgugcacaccggcgaccagcaccaggucgggaacgagaccacggagcacggcaccaucgccaccaucacgccccaggcccccaccagcgagauccagcugacggacuacggggcccugacccucgacugcagcccccggaccggccuggacuucaacgagauggugcugcucaccaugaaggagaaguccuggcugguccacaagcagugguuccuggaccucccgcugcccuggacguccggggccagcaccagccaggagaccuggaaccgccaggaccugcucgugaccuucaagacggcgcacgccaagaagcaggagguggucgugcugggcucccaggagggcgccaugcacaccgcccugaccggggccaccgagauccagacgagcggcaccaccaccaucuucgcggggcaccucaagugccggcugaagauggacaagcugacgcucaagggcaccuccuacgugaugugcaccgggagcuucaagcuggagaaggaggucgccgagacccagcacggcacggugcuggugcaggucaaguacgagggcaccgacgcccccugcaagauccccuucuccacccaggacgagaagggggugacccagaacggccgccugaucacggccaacccgaucgugaccgacaaggagaagcccgucaacaucgagaccgagccgcccuucggggagagcuacaucguggugggcgcgggcgagaaggcccucaagcuguccugguucaagaaggggagcuccaucggcaagauguucgaggccaccgcccgcggggcccgccggauggcgauccugggcgacacggccugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggcggacagcccgaagcggcugagcgccgccaucggcaaggccugggaggagggggugugcggcauccgcuccgccacccggcuggagaacaucauguggaagcagaucagcaacgagcucaaccacauccugcuggagaacgacaugaaguucaccguggucgugggggacgcgaacggcauccucgcccaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggcguggaacaucugggagguggaggacuacggcuucgggaucuucaccacgaacaucuggcugaagcugcgcgacuccuacacccagaugugcgaccaccggcucaugagcgccgccaucaaggacuccaaggccguccacgccgacaugggcuacuggaucgagagcgagaagaacgagaccuggaagcuggcgcgcgccuccuucaucgaggugaagaccugcacguggcccaagagccacacccugugguccaacggcgugcucgagagcgagaugaucauccccaagaucuacgggggcccgaucucccagcacaacuaccggagcggguacuucacccagaccgccggccccuggcaccuggggaagcuggagcucgacuucgaccugugcgagggcacgaccgucgugguggacgagcacugcggcaaccgcgggcccucccugcggaccaccacggucaccggcaagaucauccacgaguggugcugccgcagcugcacccucccgccccugcgguuccgcggggaggacggcugcugguacgggauggagauccggcccgugaaggagaaggaggagaaccuggugcgcuccauggucagcgccggcagcggcgagguggacuccuucagccucgggauccugugcgccuccaucaugaucgaggaggugaugcggagccgcuggucccggaagaugcugaugaccggcacgcucgcggucuuccugcugcucgugauggggcagcugaccuggaacgaccugauccgccucugcaucauggugggcgccaacgccagcgaccgcauggggaugggcaccaccuaccuggcccugauggccacguucaagaugcggcccauguucgcggucggccuccuguuccgccggcugaccucccgcgaggugcuccugcugaccaucgggcucagccugguggccuccgucgagcugccgaacagccucgaggagcugggcgacgggcuggccaugggcaucaugaugcucaagcugcugaccgaguuccagccccaccagcucuggacgacccugcugucccucaccuucaucaagaccacgcugagccuggacuacgccuggaagaccaccgcgauggcccucuccaucgugagccuguucccccugugccucuccaccacgagccagaagaccaccuggcugcccguccugcucggcuccuucgggugcaagccgcugaccauguuccugaucaccgagaacaagaucuggggccgcaagagcuggccccucaacgaggggaucauggccaucggcaucguguccauccugcugagcagccuccugaagaacgacgugccccuggccgggccccucaucgccggcggcaugcugaucgcgugcuacgucaucuccgggagcuccgccgaccugagccucgagaaggccgccgagguguccugggagcaggaggccgagcacagcggcacgucccacaacauccugguggagguccaggacgacgggaccaugaagaucaaggacgaggagcgcgacgacacccugaccauccuccugaaggcgacgcugcucgccgugagcggcguguacccgauguccauccccgccacccuguucgucugguacuucuggcagaagaagaagcagcggagcggggugcugugggacacccccagcccgcccgagguggagcgcgccguccucgacgacggcaucuaccggauccugcagcgcggccugcuggggcggagccaggugggcgugggggucuuccaggacggcguguuccacaccauguggcacgugacgcgcggggccguccucauguaccagggcaagcggcuggagcccuccugggcgagcgugaagaaggaccugaucuccuacggcgggggcuggcgcuuccaggggagcuggaacaccggcgaggaggugcaggucaucgccguggagcccgggaagaaccccaagaacgugcagaccacccccggcacguucaagacccccgagggcgaggucggggccaucgcccucgacuucaagcccggcaccuccgggagccccaucgugaaccgggagggcaagaucgugggccuguacgggaacggcgucgugaccacguccgggaccuacgugagcgccaucgcgcaggccaaggccagccaggagggcccgcugcccgagaucgaggacgaggucuucaagaagcgcaaccucaccaucauggaccugcaccccggguccggcaagacccggcgcuaccugccggccaucgugcgggaggcgaucaagcgcaagcuccggacgcugauccuggcccccacccgcguggucgccagcgagauggccgaggcccucaagggcaugcccauccgcuaccagaccaccgcggugaaguccgagcacacggggcgggagaucguggaccugaugugccacgccaccuucaccaugcgccugcucagccccguccgggugccgaacuacaacaugaucaucauggacgaggcccacuucaccgaccccgccuccaucgccgcgcgcggcuacaucagcacgcggguggggaugggcgaggccgccgccaucuucaugaccgccacgccgcccggguccgucgaggcguucccgcagagcaacgccgugauccaggacgaggagcgcgacauccccgagcgguccuggaacagcggcuacgacuggaucaccgacuuccccggcaagacggugugguucguccccuccaucaagagcgggaacgacaucgccaacugccugcgcaagaacggcaagcgggugauccagcugucccgcaagaccuucgacaccgaguaccagaagaccaagaacaacgacugggacuacguggucacgaccgacaucagcgagaugggggccaacuuccgggcggaccgcgugaucgacccgcggcgcugccucaagcccgugauccugaaggacggccccgagcgggucauccuggccgggcccaugccggugaccguggccuccgccgcccagcgccggggccgcaucggccggaaccagaacaaggagggggaccaguacgucuacaugggccagccccucaacaacgacgaggaccacgcgcacuggaccgaggccaagaugcugcuggacaacaucaacacgcccgaggggaucauccccgcccucuucgagccggagcgcgagaaguccgccgccaucgacggcgaguaccgccugcgcggggaggcgcgcaagaccuucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccccuggcccuccgcgaguucaaggaguucgccgcggggcggcgcagcguguccggcgaccugauccuggagaucggcaagcucccgcagcaccugaccagccgggcccagaacgcccuggacaaccucgugaugcugcacaacuccgagcagggcgggaaggccuaccgccacgcgauggaggagcugcccgacacgaucgagacccucaugcugcuggcccucaucgccguccugaccgggggcgugacccuguucuuccucagcgggaagggccugggcaagacguccaucgggcugcucugcgugaccgccagcuccgcccugcuguggauggcgagcgucgagccccacuggaucgccgccuccaucauccucgaguucuuccugauggugcugcucauccccgagccggaccggcagcgcacgccccaggacaaccagcuggccuacguggucaucggccuccuguucaugauccugaccguggccgcgaacgagauggggcugcucgagacgaccaagaaggaccugggcaucgggcacguggccgccgagaaccaccagcacgccaccaugcuggacgucgaccuccggcccgccagcgcguggacccuguacgccguggccacgaccgugaucaccccgaugaugcgccacaccaucgagaacacgaccgccaacaucucccugaccgccaucgcgaaccaggccgccauccucaugggccuggacaagggcuggcccaucagcaagauggacaucggggucccccugcucgcccugggcugcuacucccaggugaacccccugacccucacggcggccgugcugaugcuggucgcccacuacgccaucaucgggccgggccuccaggccaaggcgacccgggaggcccagaagcgcaccgccgccgggaucaugaagaaccccaccguggacggcaucguggccaucgaccuggaccccgucguguacgacgcgaaguucgagaagcagcugggccagaucaugcuccugauccugugcacgagccagauccuccugaugcgcaccaccugggcccugugcgaguccaucacccucgccacggggccccugaccacccugugggagggcagcccggggaaguucuggaacaccacgaucgccguguccauggccaacaucuuccggggcagcuaccucgcgggcgccgggcuggccuucucccugaugaagucccucggcgggggccgccgggggaccggcgcccagggcgagacccugggggagaaguggaagcgccagcugaaccagcucagcaaguccgaguucaacaccuacaagcggagcggcaucauggaggucgaccgcuccgaggcgaaggaggggcugaagcggggcgagacgaccaagcacgccgugagccgcgggaccgccaagcugcggugguucguggagcgcaaccucgucaagcccgagggcaaggugaucgaccugggcugcgggcggggcgggugguccuacuacugcgccggccugaagaaggugaccgaggucaagggguacaccaagggcggccccgggcacgaggagcccaucccgauggccacguacggcuggaaccuggugaagcuccacagcgggaaggacguguucuucaugccgcccgagaagugcgacacccugcugugcgacaucggcgaguccagccccaacccgaccaucgaggaggggcgcacccuccggguccugaagaugguggagcccuggcugcgcggcaaccaguucugcaucaagauccucaaccccuacaugcccuccguggucgagacgcuggagcagaugcagcggaagcacggcgggaugcuggugcgcaacccgcucagccggaacuccacccacgagauguacugggugagcugcggcaccgggaacaucgucuccgcggugaacaugaccagccgcaugcugcugaaccgguucacgauggcccaccgcaagcccaccuacgagcgcgacguggaccucggcgccggcacccggcacgucgccguggagcccgagguggccaaccuggacaucaucgggcagcgcaucgagaacaucaagaacgagcacaaguccaccuggcacuacgacgaggacaaccccuaccggacgugggcguaccacggcagcuacgaggucaagccguccgggagcgccuccagcauggugaacggcgugguccgccugcucaccaagcccugggacgugauccccauggucacccagaucgccaugaccgacacgacccccuucgggcagcagcggguguucaaggagaagguggacacccgcaccccgcgggccaagcgcggcacgacccagaucauggaggucaccgccaaguggcuguggggcuuccugagccggaacaagaagccccgcaucugcacccgggaggaguucacgcgcaaggugcgguccaacgcggccaucggggccguguucgucgacgagaaccaguggaacagcgccaaggaggcgguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcucccgcgccaucugguacauguggcucggcgcccgguuccuggaguucgaggcgcugggguucaugaacgaggaccacugguucagccgcgagaacucccucagcggcguggagggggagggccugcacaagcugggguacauccuccgggacaucuccaagauccccggcggcaacauguacgccgacgacaccgccgggugggacacccgcaucacggaggacgaccugcagaacgaggccaagaucaccgagaucauggagccggagcacgcccugcucgcgaccagcaucuucaagcugaccuaccagaacaaggugguccgcgugcagcggcccgccaagaacggcacggugauggacgucaucucccgccgggaccagcgcgggagcggccaggugggcaccuacgggcugaacaccuucaccaacauggaggugcagcucauccggcagauggaguccgagggcaucuuccugcccagcgagcuggagacgcccaaccucgccgagcgcguccuggacuggcuggagaagcacggggccgagcggcucaagcgcauggccaucuccggcgacgacugcguggugaagccgaucgacgaccgguucgcgaccgcccugaccgcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggucccugcgggagaccgcgugccucggcaagagcuacgcccagauguggcagcugauguacuuccaccgccgggaccugcgccucgccgccaacgcgaucugcagcgccguccccguggacugggugcccaccucccggacgaccuggagcauccacgcccaccaccaguggaugaccaccgaggacaugcuguccgucuggaaccgcguguggaucgaggagaaccccuggauggaggacaagacgcacgugagcuccugggaggaggucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugacguccaugaagcgcuucaagaacgagagcgaccccgagggcgcccugugguga

SEQ ID NO: 8111 - RNA, 9879 nt, Artificial Sequence
  derived and/or modified CDS sequence (opt1) from DENV-1__KJ189331__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaucggcacgcuggccgucuuccugcuccugaucauggggcagcugaccuggaacgaccucauccgccugugcaucauggugggcgcgaacgccuccgaccgcauggggaugggcaccaccuaccuggcccucauggccacguucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucaccgaguuccagccccaccagcuguggacgacccugcucagccugaccuucaucaagaccacgcugucccucgacuacgccuggaagaccaccgccauggcgcugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaagacggccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggccgucuccggcguguaccccaugagcauccccgcgacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagaccacgcccggcaccuucaagacccccgagggcgaggugggggcgaucgcccuggacuucaagcccggcaccagcggguccccgaucgucaaccgggagggcaagaucgugggccuguacgggaacggcguggucacgaccagcgggaccuacguguccgccaucgcccaggccaaggcgagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcccccacccgcgugguggcguccgagauggccgaggcccugaagggcaugcccauccgcuaccagaccacggccgucaagagcgagcacaccgggcgggagaucguggaccugaugugccacgccaccuucaccaugcgccuccuguccccggugcggguccccaacuacaacaugaucaucauggacgaggcgcacuucacggaccccgccagcaucgccgcccgcggcuacaucuccacccggguggggaugggcgaggccgcggccaucuucaugaccgccacgccgcccgggagcguggaggccuucccccaguccaacgccgucauccaggacgaggagcgcgacauccccgagcggagcuggaacuccggcuacgacuggaucacggacuuccccggcaagaccgugugguucgugcccagcaucaaguccgggaacgacaucgcgaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgccgggccgaugcccgucaccguggcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgucagcggcgaccugauccucgagaucggcaagcugccccagcaccugacgcuccgggcccagaacgcgcuggacaaccuggccaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccgucuccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuucgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugcggcugcugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgcgaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccacgagccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggccacgaacauccagguggcgaucaaccagguccggcgccugaucgggaacgagaacuaccuggacuacaugaccuccaugaagcgguucaagaacgagagcgaccccgagggcgcccucugguga

SEQ ID NO: 8112 - RNA, 9879 nt, Artificial Sequence
  derived and/or modified CDS sequence (opt1) from DENV-1__KJ189332__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaccaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugcccgacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccugaucauggggcagcugaccuggaacgaccucauccgccugugcaucauggugggcgcgaacgccuccgaccgcauggggaugggcacgaccuaccuggcccucauggccaccuucaagaugcggccgauguucgccguggggcugcuguuccgccggcucaccagccgcgagguccugcugcucacgaucgggcugucccugguggcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgucucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaagaccgccgaggucagcugggagcaggaggccgagcacuccggcaccagccacaacauccugguggaggugcaggacgacgggacgaugaagaucaaggacgaggagcgcgacgacacccucaccauccugcugaaggccacccuccuggccgucuccggcguguaccccaugagcauccccgcgacgcuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacacgggcgaggagguccaggugaucgccgucgagcccgggaagaacccgaagaacgugcagaccacccccggcaccuucaagacgcccgagggcgaggugggggcgaucgcccuggacuucaagcccggcaccagcggguccccgaucgucaaccgggagggcaagaucgugggccuguacgggaacggcguggucaccaccagcgggacguacguguccgccaucgcccaggccaaggcgagccaggagggcccccuccccgagaucgaggacgagguguucaagaagcgcaaccugaccaucauggaccugcacccggggagcggcaagacccggcgcuaccuccccgccaucguccgggaggccaucaagcgcaagcugcggacccugauccucgcccccacgcgcgugguggcguccgagauggccgaggcccugaagggcaugcccauccgcuaccagaccaccgccgucaagagcgagcacaccgggcgggagaucguggaccugaugugccacgccacguucaccaugcgccuccuguccccggugcggguccccaacuacaacaugaucaucauggacgaggcgcacuucaccgaccccgccagcaucgccgcccgcggcuacaucuccacccggguggggaugggcgaggccgcggccaucuucaugacggccacgccgcccgggagcguggaggccuucccccaguccaacgccgucauccaggacgaggagcgcgacauccccgagcggagcuggaacuccggcuacgacuggaucaccgacuuccccggcaagaccgugugguucgugcccagcaucaaguccgggaacgacaucgcgaacugccugcgcaagaacggcaagcgggucauccagcucagccgcaagacguucgacaccgaguaccagaagaccaagaacaacgacugggacuacguggugaccacggacaucuccgagaugggggccaacuuccgggccgaccgcgucaucgacccccggcgcugccugaagcccgugauccugaaggacggccccgagcgggugauccucgccgggccgaugcccgucaccguggcgagcgccgcccagcgccggggccgcaucggccggaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggacgaaggagggcgagcgcaagaagcugcggccccgcuggcuggacgcgcggaccuacuccgacccgcucgcccugcgcgaguucaaggaguucgccgccgggcggcgcagcgucagcggcgaccugauccucgagaucggcaagcugccccagcaccugacccuccgggcccagaacgcgcuggacaaccuggccaugcuccacaacuccgagcagggcgggaaggccuaccgccacgccauggaggagcugcccgacaccaucgagacgcugaugcuccuggcgcugaucgccgugcucaccgggggcgugacccuguucuuccugagcgggaagggccucggcaagaccuccaucgggcugcugugcgucacggccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagaccacgaagaaggaccucggcaucgggcacgucgcggccgagaaccaccagcacgccaccaugcuggacguggaccugcggccggccagcgccuggacccucuacgcgguggccaccacggucaucacccccaugaugcgccacaccaucgagaacaccacggccaacaucucccugaccgccaucgccaaccaggcggccauccugaugggccucgacaagggcuggcccaucagcaagauggacaucggggugccccugcuggcccucggcugcuacucccaggugaacccgcugacccugaccgccgcgguccucaugcugguggcccacuacgccaucaucgggcccggccugcaggccaaggccacgcgggaggcgcagaagcgcaccgccgccgggaucaugaagaaccccaccguggacggcaucgucgccaucgaccucgaccccgugguguacgacgccaaguucgagaagcagcugggccagaucaugcugcucauccugugcaccagccagauccugcucaugcgcacgaccugggcgcugugcgaguccaucacccuggccaccgggccgcucacgacccugugggagggcagccccgggaaguucuggaacaccaccaucgccgucuccauggccaacaucuuccggggcagcuaccuggccggcgcggggcucgccuucucccugaugaagucccugggcgggggccgccgggggacgggcgcccagggcgagacccucggggagaaguggaagcgccagcugaaccagcuguccaagagcgaguucaacaccuacaagcggagcggcaucauggagguggaccgcuccgaggccaaggaggggcucaagcggggcgagaccaccaagcacgcggugagccgcgggacggccaagcugcggugguucgucgagcgcaaccuggugaagcccgagggcaaggugaucgaccugggcugcgggcggggcgggugguccuacuacugcgccggccucaagaaggucaccgaggugaagggguacaccaagggcggccccgggcacgaggagccgauccccauggccaccuacggcuggaaccuggugaagcugcacagcgggaaggacgucuucuucaugccgcccgagaagugcgacacgcuccugugcgacaucggcgaguccagcccgaaccccaccaucgaggaggggcgcacccugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacgcacgagauguacugggucagcugcggcaccgggaacaucguguccgccgugaacaugaccagccgcaugcuccugaaccgguucaccauggcgcaccgcaagcccacguucgagcgcgacgucgaccugggcgccggcacccggcacguggccguggagcccgaggucgccaaccucgacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggugaacggcgucgugcggcugcugacgaagcccugggacgugauccccauggucacccagaucgccaugaccgacaccacgccguucgggcagcagcgcguguucaaggagaaggucgacacccggacgccccgggccaagcggggcaccacgcagaucauggaggugaccgccaaguggcucuggggcuuccugucccgcaacaagaagccccggaucugcacccgcgaggaguucacccggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgacgugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucaccgaggacgaccuccagaacgaggccaagaucacggacaucauggagcccgagcacgcccugcuggccaccagcaucuucaagcucaccuaccagaacaaggucgugcgcgugcagcgccccgcgaagaacggcaccgucauggacgugaucucccggcgcgaccagcgggggagcggccaggugggcacguacgggcugaacaccuucaccaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgccaccgcgcucacggcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccaccagccgcaccacguggagcauccacgcccaccaccaguggaugaccaccgaggacaugcucuccguguggaaccggguguggaucgaggagaacccguggauggaggacaagacccacgucagcuccugggaggaggugcccuaccuggggaagcgcgaggaccaguggugcggcagccugaucggccucacggcccgcgccaccugggccaccaacauccagguggcgaucaaccagguccggcgccugaucgggaacgagaacuaccuggacuacaugaccuccaugaagcgguucaagaacgagagcgaccccgagggcgcccucugguga

SEQ ID NO: 8113 - RNA, 9879 nt, Artificial Sequence
  derived and/or modified CDS sequence (opt1) from DENV-1__KJ189334__SS-prME
agcgugaccaugcugcucaugcugcugcccaccgcccucgccuuccaccugaccacccggggcggggagccgcacaugaucgugagcaagcaggagcggggcaagagccuccucuucaagguguccgcgggggugaacaugugcacccugaucgccauggaccugggcgagcucugcgaggacaccaugaccuacaagugcccccagaucaccgaggccgagcccgacgacgucgacugcuggugcaacgccaccgacaccugggugaccuacgggaccugcagccagaccggcgagcaccgccgggacaagcgcuccguggcccuggcgccccacgucggccuggggcucgagacccggaccgagaccuggaugagcuccgagggcgccuggaagcagauccagcgcguggagaccugggcccugcggcaccccggguucaccgugaucgccuucuuccuggcgcacgccaucggcacgagcaucacccagaaggggaucaucuucauccuccugaugcuggucacccccuccauggccaugcgcugcgugggcaucggcaaccgggacuucguggaggggcucagcggcgccaccugggucgacguggugcuggagcacggguccugcgucacgaccauggccaagaacaagcccacccuggacaucgagcuccugaagaccgaggugacgaaccccgcgauccugcgcaagcucugcaucgaggccaagaucagcaacaccaccaccgacucccggugccccacgcagggcgaggccacccugguggaggagcaggacgccaacuucgucugccgccggaccuucguggaccgcggcugggggaacggcugcgggcuguucggcaaggggagccuccugaccugcgccaaguucaagugcgugacgaagcuggagggcaagaucguccaguacgagaaccucaaguacuccgugaucgugaccguccacaccggcgaccagcaccagguggggaacgagaccacggagcacggcaccaucgcgaccaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccgccaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccggcugaagauggacaagcugacgcucaagggcaccuccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagaaggggagcuccaucggcaagauguucgaggccaccgcccgcggggcgcgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggccuggaacaucugggaggucgaggacuacggcuucgggaucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacggcguccucgagagcgagaugaucauccccaagaucuacgggggcccgaucucccagcacaacuaccggcccggguacuucacccagaccgccggccccuggcaccuggggaagcuggagcucgacuucgaccugugcgagggcacgaccgugguggucgacgagcacugcggcaaccgcgggccgagccugcggaccaccacggugaccggcaagaucauccacgaguggugcugccgcuccugcacccugccgccccugcgguuccgcggggaggacggcugcugguacgggauggagauccggcccgugaaggagaaggaggagaaccugguccgcagcaugguguccgccggcagcggcgagguggacagcuucucccucgggauccugugcgucagcaucaugaucgaggaggugaugcggucccgcuggagccggaagaugcugaugaccggcacgcucgccguguuccugcugcucgucauggggcagcugaccuggaacgaccugauccgccucugcaucauggugggcgccaacgcguccgaccgcauggggaugggcaccaccuaccuggcccugauggccacguucaagaugcggccgauguucgccgugggccuccuguuccgccggcugaccagccgcgagguccuccugcugaccaucgggcucucccugguggccagcgucgagcugcccaacucccucgaggagcugggcgacgggcuggcgaugggcaucaugaugcucaagcugcugaccgaguuccagccccaccagcucuggacgacccugcugagccucaccuucaucaagaccacgcugucccuggacuacgccuggaagaccaccgccauggcccucagcaucgugucccuguucccccugugccucagcaccacgucccagaagaccaccuggcugccggugcugcucggcagcuucgggugcaagccccugaccauguuccugaucaccgagaacaagaucuggggccggaaguccuggccccucaacgaggggaucauggcgaucggcaucgucagcauccugcuguccagccuccugaagaacgacgugccccuggccgggccgcucaucgccggcggcaugcugaucgccugcuacgugaucagcggguccagcgccgaccugucccucgagaaggcggccgaggucagcugggagcaggaggccgagcacuccggcacgagccacaacauccugguggaggugcaggacgacgggaccaugaagaucaaggacgaggagcgcgacgacacccugaccauccuccugaaggccacgcugcucgccgucuccggcguguaccccaugagcauccccgcgacccuguucgugugguacuucuggcagaagaagaagcagcgguccgggguccugugggacacccccagcccgcccgagguggagcgcgccgugcucgacgacggcaucuaccggauccugcagcgcggccugcuggggcggucccaggucggcguggggguguuccaggacggcgucuuccacaccauguggcacgugacgcgcggggccgugcucauguaccagggcaagcggcuggagcccagcugggccuccgucaagaaggaccugaucagcuacggcgggggcuggcgcuuccagggguccuggaacaccggcgaggagguccaggugaucgccgucgagcccgggaagaacccgaagaacgugcagaccacccccggcacguucaagacccccgagggcgaggugggggcgaucgcccucgacuucaagcccggcaccagcggguccccgaucgucaaccgggagggcaagaucgugggccuguacgggaacggcguggucaccacgagcgggaccuacguguccgccaucgcccaggccaaggcgagccaggagggcccccugcccgagaucgaggacgagguguucaagaagcgcaaccucaccaucauggaccugcacccggggagcggcaagacccggcgcuaccugcccgccaucguccgggaggccaucaagcgcaagcuccggacgcugauccuggcccccacccgcgugguggcguccgagauggccgaggcccucaagggcaugcccauccgcuaccagaccaccgccgucaagagcgagcacacggggcgggagaucguggaccugaugugccacgccaccuucaccaugcgccugcucuccccggugcggguccccaacuacaacaugaucaucauggacgaggcgcacuucaccgaccccgccagcaucgccgcccgcggcuacaucuccacgcggguggggaugggcgaggccgcggccaucuucaugaccgccacgccgcccgggagcguggaggccuucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgcgaacugccugcgcaagaacggcaagcgggucauccagcugagccgcaagaccuucgacaccgaguaccagaagaccaagaacaacgacugggacuacguggugacgaccgacaucuccgagaugggggccaacuuccgggccgaccgcgucaucgacccccggcgcugccucaagcccgugauccugaaggacggccccgagcgggugauccuggccgggccgaugcccgucaccguggcgagcgccgcccagcgccggggccgcaucggccggaaccagaacaaggagggggaccaguacgucuacaugggccagccccucaacaacgacgaggaccacgcccacuggaccgaggccaagaugcugcuggacaacaucaacacgcccgaggggaucaucccggcccucuucgagcccgagcgcgagaagaacgccgccaucgacggcgaguaccgccugcgcggggaggcccgcaagaccuucguggagcugaugcggcgcggcgaccuccccguguggcuguccuacaaggucgccagcgagggcuuccaguacuccgaccggcgcuggugcuucgacggggagcggaacaaccaggugcuggaggagaacauggacguggagaucuggaccaaggagggcgagcgcaagaagcuccggccccgcuggcuggacgcgcggaccuacagcgacccgcuggcccuccgcgaguucaaggaguucgccgccgggcggcgcuccgucagcggcgaccugauccuggagaucggcaagcucccccagcaccugacccugcgggcccagaacgcgcucgacaaccuggugaugcugcacaacagcgagcagggcgggaaggccuaccgccacgccauggaggagcuccccgacacgaucgagacccugaugcugcucgcccugaucgcggugcugaccgggggcgucacccucuucuuccuguccgggaagggccugggcaagacgagcaucgggcuccugugcgugaccgccuccagcgcccugcucuggauggccuccguggagccccacuggaucgccgcgagcaucauccuggaguucuuccugaugguccuccugaucccggagcccgaccggcagcgcacgccccaggacaaccagcuggccuacguggugaucggccuccuguucaugauccugaccgucgccgccaacgagauggggcuccuggagacgaccaagaaggaccugggcaucgggcacguggccgcggagaaccaccagcacgccaccaugcucgacguggaccugcggccggccuccgccuggacccuguacgccgucgcgacgaccgugaucacccccaugaugcgccacaccaucgagaacacgaccgccaacaucagccucaccgccaucgccaaccaggccgcgauccugaugggccuggacaagggcuggcccaucuccaagauggacaucggggugccccuccuggcccugggcugcuacagccaggucaacccgcucacccugacggccgccgugcugaugcucguggcgcacuacgccaucaucgggcccggccugcaggccaaggccacccgggaggcccagaagcgcaccgcggccgggaucaugaagaaccccaccgucgacggcaucguggccaucgaccuggaccccguggucuacgacgccaaguucgagaagcagcucggccagaucaugcugcugauccucugcacgucccagauccugcugaugcgcaccaccugggcccucugcgagagcaucacccuggcgacggggccgcugaccacccucugggagggcucccccgggaaguucuggaacaccacgaucgccgugagcauggccaacaucuuccggggcuccuaccuggccggcgccgggcuggcguucagccucaugaagucccugggcgggggccgccgggggaccggcgcccagggcgagacccugggggagaaguggaagcgccagcucaaccagcugagcaaguccgaguucaacaccuacaagcggagcggcaucauggagguggaccgcagcgaggccaaggaggggcugaagcggggcgagacgaccaagcacgccgucucccgcgggaccgcgaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagccgauccccauggccacguacggcuggaaccucgucaagcugcacuccgggaaggacguguucuucaucccgcccgagaagugcgacacccugcucugcgacaucggcgagagcuccccgaaccccaccaucgaggaggggcgcacccugcgggugcugaagauggucgagcccuggcuccgcggcaaccaguucugcaucaagauccugaaccccuacaugccgagcgugguggaggcccuggagcagaugcagcggaagcacggcgggaugcucguccgcaacccccugucccggaacagcacgcacgagauguacuggguguccugcggcaccgggaacaucgugagcgccgucaacaugaccucccgcaugcugcucaaccgguucaccauggcgcaccgcaagcccacguacgagcgcgacguggaccugggcgccggcacccggcacguggccgucgagcccgagguggccaaccuggacaucaucgggcagcgcaucgagaacaucaagaacgagcacaagagcaccuggcacuacgacgaggacaacccguacaagaccugggccuaccacggcuccuacgaggugaagcccagcggguccgcgagcuccauggucaacggcgugguccggcuccugacgaagcccugggacgugauccccauggugacccagaucgccaugaccgacaccacgccguucgggcagcagcgcgucuucaaggagaagguggacacccggacgccccgggccaagcggggcaccacgcagaucauggaggugaccgccaaguggcuguggggcuuccucagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccuggugcaccgcgagcgggagcugcacaagcagggcaagugcgcgacgugcguguacaacaugauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcgucgagggggagggccugcacaagcucggguacauccugcgcgacaucagcaagaucccgggcggcaacauguacgcggacgacaccgccgggugggacacccggaucaccgaggacgaccugcagaacgaggccaagaucacggagaucauggagcccgagcacgcccuccuggccaccuccaucuucaagcugaccuaccagaacaagguggugcgcguccagcgccccgcgaagaacggcaccgugauggacgugaucagccggcgcgaccagcggggguccggccaggucggcacguacgggcucaacaccuucaccaacauggaggugcagcugauccgccagauggagagcgagggcaucuuccugcccuccgagcucgagaccccgaaccuggccgagcgggugcuggacuggcucgagaagcacggggccgagcgccugaagcggauggccaucagcggcgacgacugcgucgugaagcccaucgacgaccgcuucgccacggcgcugaccgcccucaacgacauggggaaggugcggaaggacaucccccagugggagcccuccaagggcuggaacgacuggcagcaggucccguucugcagccaccacuuccaccagcugaucaugaaggacggccgcgagaucguggugcccugccggaaccaggacgagcuggucgggcgcgcccgggugucccagggcgccggguggagccuccgcgagaccgccugccugggcaaguccuacgcgcagauguggcagcugauguacuuccaccggcgcgaccuccggcuggccgccaacgccaucugcagcgcggugcccgucgacugggugcccaccucccgcaccacguggagcauccacgcccaccaccaguggaugaccaccgaggacaugcugagcguguggaaccgggucuggaucgaggagaacccguggauggaggacaagacccacguguccagcugggaggaggugcccuaccucgggaagcgcgaggaccaguggugcggcucccugaucggccugacggcccgcgccaccugggccaccaacauccaggucgcgaucaaccaggugcggcgccucaucgggaacgagaacuaccuggacuacaugaccagcaugaagcgguucaagaacgaguccgaccccgagggcgcccugugguga

SEQ ID NO: 8114 - RNA, 9879 nt, Artificial Sequence
  derived and/or modified CDS sequence (opt1) from DENV-1__KJ189335__SS-prME
agcgugaccaugcugcucaugcugcugcccaccgcccucgccuuccaccugaccacccggggcggggagccgcacaugaucgugagcaagcaggagcggggcaagagccuccucuucaagaccuccgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcgauccugcgcaagcucugcaucgaggccaagaucagcaacaccaccacggacucccggugccccacccagggcgaggccacccugguggaggagcaggacgccaacuucgugugccgccggaccuucgucgaccgcggcugggggaacggcugcgggcuguucggcaaggggagccuccugacgugcgccaaguucaagugcgugaccaagcuggagggcaagaucgugcaguacgagaaccucaaguacuccgucaucgugaccgugcacaccggcgaccagcaccaggucgggaacgagacgaccgagcacggcaccaucgcgaccaucacgccccaggcccccacgagcgagauccagcugaccgacuacggggcccugacccucgacugcagcccccggaccggccuggacuucaacgagauggugcugcucacgaugaaggagaaguccuggcugguccacaagcagugguuccuggaccucccgcugcccuggaccuccggggccagcaccagccaggagaccuggaaccgccaggaccugcucgugacguucaagaccgcccacgcgaagaagcaggagguggucgugcugggcucccaggagggcgccaugcacaccgcccugaccggggccacggagauccagaccagcggcaccaccacgaucuucgccgggcaccucaagugccggcugaagauggacaagcugacccucaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccgcccuucggggagagcuacaucguggugggcgccggcgagaaggcgcucaagcuguccugguucaagaaggggagcuccaucggcaagauguucgaggccacggcccgcggggcgcgccggauggccauccugggcgacaccgcgugggacuucgggagcaucggcggcgucuucaccuccguggggaagcucgugcaccaggucuucggcaccgccuacggggugcuguucagcggcguguccuggacgaugaagaucgggaucggcauccugcucaccuggcugggccugaacagccgcuccaccagccucuccaugaccugcaucgccgucgggauggugacgcuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacgguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccugugguccaacggcgugcucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgugagcaucaugaucgaggaggucaugcggucccgcuggagccggaagaugcugaugacgggcacccucgccguguuccugcugcucgugauggggcagcugaccuggaacgaccugauccgccucugcaucauggucggcgccaacgcguccgaccgcauggggaugggcaccacguaccuggcccugauggccaccuucaagaugcggccgauguucgccgugggccuccuguuccgccggcugaccagccgcgaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccauggcccucagcaucgucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugaagaucaaggacgaggagcgcgacgacacccugacgauccuccugaaggccacccugcucgccguguccggcgucuaccccaugagcauccccgcgacccuguucgugugguacuucuggcagaagaagaagcagcgguccggggugcugugggacacccccagcccgcccgaggucgagcgcgccgugcucgacgacggcaucuaccggauccugcagcgcggccugcuggggcggucccaggugggcgucgggguguuccaggacggcguguuccacacgauguggcacgucacccgcggggccgugcucauguaccagggcaagcggcuggagcccagcugggccuccgugaagaaggaccugaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccugcccgagaucgaggacgagguguucaagaagcgcaaccucaccaucauggaccugcacccggggagcggcaagacgcggcgcuaccugcccgccaucgugcgggaggccaucaagcgcaagcuccggacccugauccuggcccccacccgcgucguggcguccgagauggccgaggcccucaagggcaugcccauccgcuaccagaccacggccgucaagagcgagcacaccgggcgggagaucgucgaccugaugugccacgccaccuucaccaugcgccugcucuccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcugagccgcaagaccuucgacaccgaguaccagaagacgaagaacaacgacugggacuacgucgugaccaccgacaucuccgagaugggggccaacuuccgggccgaccgcgugaucgacccccggcgcugccucaagcccgucauccugaaggacggccccgagcgggugauccuggccgggccgaugcccgugaccgucgcgagcgccgcccagcgccggggccgcaucggccggaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaagaacgccgccaucgacggcgaguaccgccugcgcggggaggcccgcaagaccuucgucgagcugaugcggcgcggcgaccuccccguguggcuguccuacaagguggccagcgagggcuuccaguacuccgaccggcgcuggugcuucgacggggagcggaacaaccagguccuggaggagaacauggacguggagaucuggaccaaggagggcgagcgcaagaagcuccggccccgcuggcuggacgcgcggaccuacagcgacccgcuggcccuccgcgaguucaaggaguucgccgccgggcggcgcuccgugagcggcgaccugauccuggagaucggcaagcucccccagcaccugacgcugcgggcccagaacgcgcucgacaaccuggucaugcugcacaacagcgagcagggcgggaaggccuaccgccacgccauggaggagcuccccgacaccaucgagacccugaugcugcucgcccugaucgcggugcugaccgggggcgugacccucuucuuccuguccgggaagggccugggcaagaccagcaucgggcuccugugcgucaccgccuccagcgcccugcucuggauggccuccguggagccccacuggaucgccgcgagcaucauccuggaguucuuccugauggugcuccugaucccggagcccgaccggcagcgcacgccccaggacaaccagcuggccuacgucgugaucggccuccuguucaugauccugacgguggccgccaacgagauggggcuccuggagaccaccaagaaggaccugggcaucgggcacgucgccgcggagaaccaccagcacgccaccaugcucgacguggaccugcggccggccuccgccuggacgcuguacgccguggcgaccaccgucaucacccccaugaugcgccacacgaucgagaacaccaccgccaacaucagccucaccgccaucgccaaccaggccgcgauccugaugggccuggacaagggcuggcccaucuccaagauggacaucggggugccccuccuggcccugggcugcuacagccaggugaacccgcucacgcugaccgccgccguccugaugcucguggcgcacuacgccaucaucgggcccggccugcaggccaaggccacccgggaggcccagaagcgcaccgcggccgggaucaugaagaaccccacgguggacggcaucgucgccaucgaccuggaccccgugguguacgacgccaaguucgagaagcagcucggccagaucaugcugcugauccucugcaccucccagauccugcugaugcgcaccaccugggcccucugcgagagcaucacgcuggcgaccgggccgcugaccacccucugggagggcucccccgggaaguucuggaacacgaccaucgccgucagcauggccaacaucuuccggggcuccuaccuggccggcgccgggcuggcguucagccucaugaagucccugggcgggggccgccgggggaccggcgcccagggcgagacccugggggagaaguggaagcgccagcucaaccagcugagcaaguccgaguucaacacguacaagcggagcggcaucauggagguggaccgcagcgaggccaaggaggggcugaagcggggcgagaccaccaagcacgccgugucccgcgggaccgcgaagcuccggugguucgucgagcgcaaccuggugaagcccgagggcaaggugaucgaccugggcugcgggcggggcggguggagcuacuacugcgccggccugaagaaggucaccgaggugaagggguacacgaagggcggccccgggcacgaggagccgauccccauggccaccuacggcuggaaccucgugaagcugcacuccgggaaggacgucuucuucaucccgcccgagaagugcgacacccugcucugcgacaucggcgagagcuccccgaaccccaccaucgaggaggggcgcacgcugcgggugcugaagaugguggagcccuggcuccgcggcaaccaguucugcaucaagauccugaaccccuacaugccgagcgucguggaggcccuggagcagaugcagcggaagcacggcgggaugcucgugcgcaacccccugucccggaacagcacccacgagauguacugggucuccugcggcaccgggaacaucgugagcgccgugaacaugaccucccgcaugcugcucaaccgguucacgauggcgcaccgcaagcccaccuacgagcgcgacgucgaccugggcgccggcacccggcacguggccguggagcccgaggucgccaaccuggacaucaucgggcagcgcaucgagaacaucaagaacgagcacaagagcaccuggcacuacgacgaggacaacccguacaagacgugggccuaccacggcuccuacgaggugaagcccagcggguccgcgagcuccauggugaacggcgucgugcggcuccugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcuguggggcuuccucagccgcaacaagaagccccggaucugcacccgcgaggaguucacgcggaaggugcgcuccaacgccgcgaucggggccgucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagaucccgggcggcaacauguacgcggacgacaccgccgggugggacacccggaucacggaggacgaccugcagaacgaggccaagaucaccgagaucauggagcccgagcacgcccuccuggccaccuccaucuucaagcugaccuaccagaacaaggucgugcgcgugcagcgccccgcgaagaacggcacggucauggacgugaucagccggcgcgaccagcggggguccggccaggugggcaccuacgggcucaacaccuucaccaacauggagguccagcugauccgccagauggagagcgagggcaucuuccugcccuccgagcucgagacgccgaaccuggccgagcgggugcuggacuggcucgagaagcacggggccgagcgccugaagcggauggccaucagcggcgacgacugcguggucaagcccaucgacgaccgcuucgccaccgcgcugaccgcccucaacgacauggggaaggugcggaaggacaucccccagugggagcccuccaagggcuggaacgacuggcagcaggucccguucugcagccaccacuuccaccagcugaucaugaaggacggccgcgagaucgucgugcccugccggaaccaggacgagcugguggggcgcgcccgggucucccagggcgccggguggagccuccgcgagaccgccugccugggcaaguccuacgcgcagauguggcagcugauguacuuccaccggcgcgaccuccggcuggccgccaacgccaucugcagcgcggugcccguggacuggguccccaccucccgcacgaccuggagcauccacgcccaccaccaguggaugaccaccgaggacaugcugagcguguggaaccggguguggaucgaggagaacccguggauggaggacaagacgcacgucuccagcugggaggaggugcccuaccucgggaagcgcgaggaccaguggugcggcucccugaucggccugaccgcccgcgccaccugggccaccaacauccagguggcgaucaaccagguccggcgccucaucgggaacgagaacuaccuggacuacaugacgagcaugaagcgguucaagaacgaguccgaccccgagggcgcccugugguga

SEQ ID NO: 8115 - RNA, 9879 nt, Artificial Sequence
  derived and/or modified CDS sequence (opt1) from DENV-1__KJ189336__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggaucgugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggaggcccucgagcagaugcagcggaagcacggcgggaugcuggugcgcaacccccugagccggaacuccacccacgagauguacugggucagcugcggcaccgggaacaucguguccgccgugaacaugaccagccgcaugcuccugaaccgguucacgauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccaccuggcacuacgacgaggacaacccguacaagacgugggccuaccacggcagcuacgaggugaagcccuccgggagcgcguccagcauggugaacggcgucgugcggcugcugaccaagcccugggacgucauccccauggugacccagaucgccaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacccggaucacggaggacgaccuccagaacgaggccaagaucaccgagaucauggagcccgagcacgcccugcuggccaccagcaucuucaagcucaccuaccagaacaaggucgugcgcgugcagcgccccgcgaagaacggcacggucauggacgugaucucccggcgcgaccagcgggggagcggccaggugggcaccuacgggcugaacaccuucaccaacauggagguccagcugauccgccagauggaguccgagggcaucuuccuccccagcgagcuggagacgccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccaccagccgcacgaccuggagcauccacgcccaccaccaguggaugaccaccgaggacaugcucuccguguggaaccggguguggaucgaggagaacccguggauggaggacaagacgcacgucagcuccugggaggaggugcccuaccuggggaagcgcgaggaccaguggugcggcagccugaucggccucaccgcccgcgccaccugggccaccaacauccagguggcgaucaaccagguccggcgccugaucgggaacgagaacuaccuggacuacaugacguccaugaagcgguucaagaacgagagcgaccccgagggcgcccucugguga

SEQ ID NO: 8116 - RNA, 9879 nt, Artificial Sequence
  derived and/or modified CDS sequence (opt1) from DENV-1__KJ189337__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaucuggaaccgccaggaccuccuggugaccuucaagacggcccacgcgaagaagcaggagguggucgugcugggcucccaggagggcgccaugcacaccgcccucaccggggccaccgagauccagacgagcggcaccaccaccaucuucgccgggcaccugaagugccggcugaagauggacaagcucacgcugaagggcaccuccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggccuggaacaucugggagguggaggacuacggcuucgggaucuucaccacgaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcacgaccgucgugguggacgagcacugcggcaaccgcgggccgagccuccggaccaccacggucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacgcuggccgucuuccugcuccugaucauggggcagcugaccuggaacgaccucauccgccugugcaucauggugggcgcgaacgccuccgaccgcauggggaugggcaccaccuaccuggcccucauggccacguucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucaccgaguuccagccccaccagcuguggacgacccugcucagccugaccuucaucaagaccacgcugucccucgacuacgccuggaagaccaccgccauggcgcugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcacgagccacaacauccugguggaggugcaggacgacgggaccaugaagaucaaggacgaggagcgcgacgacacccucaccauccugcugaaggccacgcuccuggcggucuccggcguguaccccaugagcauccccgccacccuguucgugugguacuucuggcagaagcggaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacaccauguggcacgugacgcgcggggccgugcugauguaccagggcaagcgccuggagcccagcugggccuccgucaagaaggaccucaucagcuacggcgggggcuggcgguuccagggguccuggaacaccggcgaggagguccaggugaucgcggucgagcccgggaagaacccgaagaacgugcagaccacccccggcacguucaagacccccgagggcgaggugggggccaucgcccuggacuucaagcccggcaccagcggguccccgaucgucaaccgcgagggcaagaucgugggccuguacgggaacggcguggucaccacgagcgggaccuacguguccgccaucgcccaggcgaaggccagccaggagggcccccuccccgagaucgaggacgagguguucaagaagcggaaccugaccaucauggaccugcacccggggagcggcaagacccgccgguaccuccccgccaucguccgcgaggccaucaagcggaagcugcgcacgcugauccucgcgcccacccgcgugguggccuccgagauggccgaggcccugaagggcaugcccauccgguaccagaccaccgccgucaagagcgagcacacggggcgcgagaucguggaccugaugugccacgcgaccuucaccaugcggcuccuguccccggugcgcguccccaacuacaacaugaucaucauggacgaggcccacuucaccgaccccgccagcaucgccgcccggggcuacaucuccacgcgcguggggaugggcgaggcggccgccaucuucaugaccgccacgccgcccgggagcguggaggccuucccccaguccaacgcggucauccaggacgaggagcgggacauccccgagcgcagcuggaacuccggcuacgacuggaucaccgacuuccccggcaagacggugugguucgugcccagcaucaaguccgggaacgacaucgccaacugccugcggaagaacggcaagcgcgucauccagcucagccggaagaccuucgacaccgaguaccagaagaccaagaacaacgacugggacuacguggugacgaccgacaucuccgagaugggggccaacuuccgcgccgaccgggucaucgacccccgccggugccugaagcccgugauccugaaggacggccccgagcgcgugauccucgcggggccgaugcccgucaccguggccagcgccgcccagcggcgcggccggaucggccgcaaccagaacaaggagggggaccaguacguguacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccggcugcgcggggaggcccggaagaccuucgucgagcucaugcgccggggcgaccugcccguguggcugagcuacaaggucgcguccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcccgcaccuacuccgacccgcucgcccugcgggaguucaaggaguucgccgccgggcgccggagcgucagcggcgaccugauccucgagaucggcaagcugccccagcaccugacccuccgcgcgcagaacgcccuggacaaccuggugaugcuccacaacuccgagcagggcgggaaggccuaccggcacgccauggaggagcugcccgacacgaucgagacccugaugcuccuggcgcugaucgccgugcucaccgggggcgucacccuguucuuccugagcgggaagggccucggcaagacguccaucgggcugcugugcgugaccgccagcuccgcccuccuguggauggccagcguggagccccacuggaucgcggccuccaucauccuggaguucuuccucaugguccugcugaucccggagcccgaccgccagcggacgccccaggacaaccagcucgccuacguggugaucggccugcuguucaugauccucaccgucgccgccaacgagauggggcugcuggagacgaccaagaaggaccucggcaucgggcacguggcggccgagaaccaccagcacgccaccaugcuggacguggaccugcgcccggccagcgccuggacccucuacgcggucgccacgaccgugaucacccccaugaugcggcacaccaucgagaacacgaccgccaacaucucccugaccgccaucgccaaccaggcggccauccugaugggccucgacaagggcuggcccaucagcaagauggacaucggggugccccugcuggcccucggcugcuacucccaggucaacccgcugacccugacggccgcggugcucaugcugguggcccacuacgccaucaucgggcccggccugcaggccaaggccacccgcgaggcgcagaagcgcaccgccgccgggaucaugaagaaccccaccgucgacggcaucguggccaucgaccucgaccccguggucuacgacgccaaguucgagaagcagcugggccagaucaugcugcucauccugugcacgagccagauccugcucaugcggaccaccugggcgcugugcgaguccaucacccuggccacggggccgcucaccacccugugggagggcagccccgggaaguucuggaacaccacgaucgccguguccauggccaacaucuuccgcggcagcuaccuggccggcgcggggcucgccuucucccugaugaagucccugggcgggggccggcgcgggaccggcgcccagggcgagacccucggggagaaguggaagcggcagcugaaccagcuguccaagagcgaguucaacaccuacaagcgcagcggcaucauggagguggaccgguccgaggccaaggaggggcucaagcgcggcgagacgaccaagcacgcggucagccgggggaccgccaagcugcgcugguucguggagcggaaccuggugaagcccgagggcaaggucaucgaccugggcugcgggcgcggcgggugguccuacuacugcgccggccucaagaaggugaccgaggugaagggguacaccaagggcggccccgggcacgaggagccgauccccauggccacguacggcuggaaccuggucaagcugcacagcgggaaggacguguucuucaugccgcccgagaagugcgacacccuccugugcgacaucggcgaguccagcccgaaccccaccaucgaggaggggcggacccugcgcgugcucaagauggucgagcccuggcugcggggcaaccaguucugcaucaagauccugaaccccuacaugccguccgugguggagacgcucgagcagaugcagcgcaagcacggcgggaugcugguccggaacccccugagccgcaacuccacccacgagauguacugggugagcugcggcaccgggaacaucguguccgccgucaacaugaccagccggaugcuccugaaccgcuucacgauggcgcaccgcaagcccaccuucgagcgggacguggaccugggcgccggcacccgccacguggccgucgagcccgagguggccaaccucgacaucaucgggcagcggaucgagaacgugaagaacgagcacaaguccaccuggcacuacgacgaggacaacccguacaagacgugggccuaccacggcagcuacgaggucaagcccuccgggagcgcguccagcauggugaacggcgugguccgccugcugaccaagcccugggacgugauccccauggucacccagaucgccaugaccgacacgaccccguucgggcagcagcggguguucaaggagaagguggacacccgcacgccccgggccaagcgcggcacgacccagaucauggaggucaccgccaaguggcucuggggcuuccugucccggaacaagaagccccgcaucugcacccgggaggaguucacgcgcaaggugcggagcaacgccgcgaucggggccguguucgucgacgagaaccaguggaacagcgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgcggacgacaccgccgggugggacacccgcaucacggaggacgaccuccagaacgaggccaagaucaccgacaucauggagcccgagcacgcccugcuggccaccagcaucuucaagcucaccuaccagaacaaggugguccgcgugcagcggcccgcgaagaacggcacggugauggacgucaucucccgccgggaccagcgcgggagcggccaggugggcaccuacgggcugaacaccuucaccaacauggaggugcagcugauccggcagauggaguccgagggcaucuuccuccccagcgagcuggagacgccgaaccuggccgagcgcguccucgacuggcuggagaagcacggggccgagcggcugaagcgcauggccaucuccggcgacgacugcguggugaagcccaucgacgaccgguucgccaccgcgcucaccgcccugaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcucguggggcgggcccgcgugagccagggcgccggguggucccugcgggagaccgccugccugggcaagagcuacgcgcagauguggcagcucauguacuuccaccgccgggaccugcgccuggccgccaacgccaucugcuccgcgguccccguggacugggugcccaccagccggacgaccuggagcauccacgcccaccaccaguggaugaccaccgaggacaugcucuccgucuggaaccgcguguggaucgaggagaacccguggauggaggacaagacgcacgugagcuccugggaggagguccccuaccuggggaagcgcgaggaccaguggugcggcagccugaucggccucaccgcccgggccaccugggccaccaacauccagguggcgaucaaccaggugcgccggcugaucgggaacgagaacuaccuggacuacaugacguccaugaagcgcuucaagaacgagagcgaccccgagggcgcccucugguga

SEQ ID NO: 8117 - RNA, 9879 nt, Artificial Sequence
  derived and/or modified CDS sequence (opt1) from DENV-1__KJ189340__SS-prME
agcgugaccaugcugcucaugcugcugcccaccgcccucgccuuccaccugaccacccggggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccgugggccugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccgggggcaccuacgucagcgccaucgcccaggccaaggcgucccaggaggggccccuccccgagaucgaggacgagguguucaagaagcgcaaccugaccaucauggaccugcacccgggcagcggcaagacgcggcgcuaccuccccgccaucgugcgggaggccaucaagcgcaagcugcggacccugauccucgcccccacccgcgucguggcgagcgagauggccgaggcccugaaggggaugcccauccgcuaccagaccacggccgugaaguccgagcacaccggccgggagaucgucgaccugaugugccacgccaccuucaccaugcgccuccugagcccggugcgggugcccaacuacaacaugaucaucauggacgaggcgcacuucacggaccccgccuccaucgccgcccgcggguacaucagcacccgggucggcaugggggaggccgcggccaucuucaugaccgccacgccgcccggcuccguggaggccuucccccagagcaacgccgugauccaggacgaggagcgcgacauccccgagcgguccuggaacagcggcuacgacuggaucacggacuuccccgggaagaccgucugguucgugcccuccaucaagagcggcaacgacaucgcgaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggccgaccgcgugaucgacccccggcgcugccugaagcccgucauccugaaggacgggcccgagcgggugauccucgccggcccgaugcccgugaccgucgcguccgccgcccagcgccggggccgcaucgggcggaaccagaacaaggagggcgaccaguacguguacauggggcagccccugaacaacgacgaggaccacgcccacuggacggaggccaagaugcugcucgacaacaucaacacccccgagggcaucaucccggcgcuguucgagcccgagcgcgagaaguccgccgccaucgacggggaguaccgccugcggggcgaggcccgcaagaccuucgucgagcucaugcggcgcggcgaccugcccguguggcuguccuacaagguggccagcgagggguuccaguacuccgaccggcgcuggugcuucgacggcgagcggaacaaccagguccucgaggagaacauggacguggagaucuggaccaaggagggggagcgcaagaagcugcggccccgcuggcuggacgcgcggaccuacagcgacccgcucgcccugcgcgaguucaaggaguucgccgccggccggcgcuccgugagcggcgaccugauccucgagaucgggaagcugccccagcaccugacgcuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccggcggggugacgcuguucuuccuguccggcaagggccucgggaagaccagcaucggccugcugugcgucaccgccuccagcgcccuccuguggauggccuccguggagccccacuggaucgccgcgagcaucauccuggaguucuuccucauggugcugcugaucccggagcccgaccggcagcgcacgccccaggacaaccagcucgccuacgucgugaucgggcugcuguucaugauccucacgguggccgccaacgagaugggccugcuggagaccaccaagaaggaccucgggaucggccacgucgccgcggagaaccaccagcacgccaccaugcuggacguggaccugcggccggccuccgccuggacgcucuacgccguggcgaccaccgucaucacccccaugaugcgccacacgaucgagaacaccaccgccaacaucagccugaccgccaucgccaaccaggccgcgauccugaugggccucgacaagggguggcccaucuccaagauggacaucggcgugccccugcuggcccucgggugcuacagccaggugaacccgcugacgcugaccgccgccguccucaugcugguggcgcacuacgccaucaucggccccgggcugcaggccaaggccacccgggaggcccagaagcgcaccgcggccggcaucaugaagaaccccacgguggacggcaucgucgccaucgaccucgaccccgugguguacgacgccaaguucgagaagcagcuggggcagaucaugcugcucauccugugcaccucccagauccugcucaugcgcaccaccugggcccugugcgagagcaucacgcuggcgaccggcccgcucaccacccugugggaggggucccccggcaaguucuggaacacgaccaucgccgucagcauggccaacaucuuccggggcuccuaccuggccggggccggccucgcguucagccugaugaagucccucgggggcgggcgccgggggaccggcgcccagggggagacccucggcgagaaguggaagcgccagcugaaccagcugagcaaguccgaguucaacacguacaagcggagcgggaucauggagguggaccgcagcgaggccaaggagggccucaagcgcggggagaccaccaagcacgccgugucccgcggcaccgcgaagcugcggugguucgucgagcgcaaccuggugaagcccgagggcaaggugaucgaccuggggugcggccgcgggggcuggagcuacuacugcgccgggcucaagaaggucaccgaggugaagggcuacacgaagggcgggcccggccacgaggagccgauccccauggccaccuacggguggaaccuggugaagcugcacuccggcaaggacgucuucuucaugccgcccgagaagugcgacacccuccugugcgacaucggggagagcuccccgaaccccaccaucgaggagggccgcacgcugcgggugcucaagaugguggagcccuggcugcgcggcaaccaguucugcaucaagauccugaaccccuacaugccgagcgucguggaggcccucgagcagaugcagcggaagcacgggggcaugcuggugcgcaacccccugucccggaacagcacccacgagauguacugggucuccugcgggaccggcaacaucgugagcgccgugaacaugaccucccgcaugcuccugaaccgguucacgauggcgcaccgcaagcccaccuacgagcgcgacgucgaccugggcgccgggacccggcacguggccguggagcccgaggucgccaaccucgacaucaucggccagcgcaucgagaacaucaagaacgagcacaagagcaccuggcacuacgacgaggacaacccguacaagacgugggccuaccacggguccuacgaggugaagcccagcggcuccgcgagcuccauggugaacggggucgugcggcugcugaccaagcccugggacgucauccccauggugacccagaucgccaugaccgacacgaccccguucggccagcagcgcguguucaaggagaaggucgacacccggacccccaaggccaagcgcggcacgacccagaucauggaggugaccgccaaguggcucuggggguuccugagccggaacaagaagccccgcaucugcacccgggaggaguucacgcgcaaggugcgguccaacgccgcgaucggcgccgucuucguggacgagaaccaguggaacagcgccaaggaggccguggaggacgagcgcuucugggaccugguccaccgggagcgcgagcuccacaagcaggggaagugcgcgaccugcguguacaacaugaugggcaagcgggagaagaagcugggggaguucggcaaggccaagggcagccgcgccaucugguacauguggcugggggcccgguuccucgaguucgaggcccugggcuucaugaacgaggaccacugguucucccgcgagaacagccuguccgggguggagggcgaggggcuccacaagcugggcuacauccugcgggacaucagcaagaucccgggcgggaacauguacgcggacgacaccgccggcugggacacccgcaucacggaggacgaccuccagaacgaggccaagaucaccgagaucauggagcccgagcacgcccugcuggccaccuccaucuucaagcucaccuaccagaacaaggucgugcgggugcagcgccccgcgaagaacgggacggucauggacgugaucagccgccgggaccagcgcggcuccggccagguggggaccuacggccugaacaccuucaccaacauggagguccagcugauccggcagauggagagcgaggggaucuuccuccccuccgagcuggagacgccgaaccuggccgagcgcgugcucgacuggcuggagaagcacggcgccgagcggcugaagcgcauggccaucagcggggacgacugcguggucaagcccaucgacgaccgguucgccaccgcgcucaccgcccugaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcucgugggccgggcccgcgucucccagggggccggcuggagccugcgggagaccgccugccuggggaaguccuacgcgcagauguggcagcucauguacuuccaccgccgggaccugcgccuggccgccaacgccaucugcagcgcggugcccguggacuggguccccaccucccggacgaccuggagcauccacgcccaccaccaguggaugaccaccgaggacaugcucagcguguggaaccgcguguggaucgaggagaacccguggauggaggacaagacgcacgucuccagcugggaggaggugcccuaccugggcaagcgggaggaccaguggugcggcucccugaucgggcucaccgcccgcgccaccugggccaccaacauccagguggcgaucaaccagguccgccggcugaucggcaacgagaacuaccuggacuacaugacgagcaugaagcgcuucaagaacgaguccgaccccgagggggcccucugguga

SEQ ID NO: 8118 - RNA, 9879 nt, Artificial Sequence
  derived and/or modified CDS sequence (opt1) from DENV-1__KJ189341__SS-prME
agcgugaccaugcugcucaugcugcugcccaccgcccucgccuuccaccugaccacccggggcggggagccccacaugaucgugagcaagcaggagcggggcaagagccugcuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcggccaccgccgggagaagcgcuccguggcccuggcgccccacguggggcugggccucgagacgcggaccgagaccuggaugagcuccgagggggccuggaagcagauccagcgggucgagaccugggcccugcggcaccccggcuucacggugaucgcccuguuccucgcgcacgccaucgggaccagcaucacccagaagggcaucaucuucauccugcugaugcucgugacccccuccauggccaugcgcugcgucggcaucgggaaccgggacuucguggagggccugagcggggccacguggguggacgucgugcuggagcacggcuccugcgugaccaccauggccaagaacaagcccacccucgacaucgagcugcugaagacggaggucaccaaccccgcggugcuccgcaagcugugcaucgaggccaagaucagcaacaccaccacggacucccggugccccacccagggcgaggccacccugguggaggagcaggacgccaacuucgucugccgccggaccuucguggaccgcggguggggcaacgggugcggccucuucgggaagggcagccugcugacgugcgccaaguucaagugcgugaccaagcucgagggcaagaucguccaguacgagaaccugaaguacuccgugaucgugaccguccacaccggggaccagcaccaggugggcaacgagacgaccgagcacgggaccaucgcgaccaucacgccccaggcccccacgagcgagauccagcugaccgacuacggcgcccucacccuggacugcagcccccggaccgggcuggacuucaacgagaugguccuccugacgaugaaggagaaguccuggcuggugcacaagcagugguuccucgaccugccgcugcccuggaccuccggcgccagcaccagccaggagaccuggaaccgccaggaccuccuggugacguucaagaccgcccacgcgaagaagcaggaggucguggugcugggcucccaggagggggccaugcacaccgcccucaccggcgccacggagauccagaccagcgggaccaccacgaucuucgccggccaccugaagugccggcugaagauggacaagcucacccugaaggggaccuccuacgucaugugcaccggccccuucaagcuggagaaggagguggcggagacgcagcacggcaccgugcugguccaggugaaguacgaggggaccgacgcccccugcaagaucccguucagcacccaggacgagaagggcgugacgcagaacgggcgccucaucaccgccaaccccaucgucaccgacaaggagaagcccgugaacaucgagaccgagcccccguucggcgaguccuacaucguggucggcgccggggagaaggcgcugaagcugagcugguucaagaagggcuccagcaucgggaagauguucgaggccacggcccggggcgcccgccggauggccauccucggggacaccgcgugggacuucggcuccaucggcgggguguucaccagcgugggcaagcugguccaccagguguucgggaccgccuacggcgugcuguucuccggggucagcuggacgaugaagaucggcaucggcauccuccugaccuggcuggggcucaacucccgcagcaccucccugagcaugaccugcaucguggugggcaucgucacgcuguaccucggggugauggugcaggccgacuccggcugcgucaucaacuggaaggggcgcgagcugaagugcggcagcggcaucuucgugaccaacgaggugcacaccuggaccgagcaguacaaguuccaggccgacucccccaagcggcugagcgccgcgaucgggaaggccugggaggagggcgucugcgggauccgcagcgccacccggcucgagaacaucauguggaagcagaucuccaacgagcugaaccacauccugcucgagaacgacaugaaguucacggugguggucggcgacgccaacgggauccuggcccagggcaagaagaugauccgcccccagcccauggagcacaaguacagcuggaaguccuggggcaaggcgaagaucaucggggccgacacccagaacaccaccuucaucaucgacggcccggacacgcccgagugccccgacaaccagcgggccuggaacaucugggagguggaggacuacggguucggcaucuucaccaccaacaucuggcugaagcuccgcgacagcuacacccagaugugcgaccaccggcugauguccgccgcgaucaaggacagcaaggccgugcacgccgacaugggcuacuggaucgaguccgagaagaacgagacguggaagcuggcccgcgccagcuucaucgaggucaagaccugcaccuggcccaagucccacacccucuggagcaacggggugcuggaguccgagaugaucaucccgaagaucuacggcgggcccaucagccagcacaacuaccggcccggcuacuucacgcagaccgcggggccguggcaccugggcaagcucgagcuggacuucgaccugugcgagggcaccaccguggucguggacgagcacugcgggaaccgcggccccucccuccggacgaccaccgugaccgggaagaucauccacgaguggugcugccgcagcugcacgcugccgccccugcgguuccgcggcgaggacgggugcugguacggcauggagauccggccggucaaggagaaggaggagaaccucgugcgcuccauggugagcgccggcuccggggaggucgacagcuucagccugggcauccugugcgccuccaucaugaucgaggaggugaugcggagccgcuggucccggaagaugcucaugaccgggacccuggccguguuccugcuccugaucaugggccagcugaccuggaaggaccucauccgccugugcaucauggucggggccaacgcgagcgaccgcaugggcaugggcacgaccuaccuggcccucauggccaccuucaagaugcggcccauguucgccguggggcugcuguuccgccggcucaccucccgcgaggugcugcugcucacgaucggccugagccuggucgccuccguggagcuccccaacagccuggaggagcugggggacggccucgcgaugggcaucaugaugcugaagcugcucaccgaguuccagccccaccagcuguggaccacccugcucucccugacguucaucaagaccacccugagccucgacuacgccuggaagaccacggccauggcccuguccaucgucagccuguucccgcucugccuguccaccaccagccagaagaccaccuggcugcccgugcuccugggguccuucggcugcaagcccagcacgauguuccugaucaccgagaacaagaucugggggcggaaguccuggccccucaacgagggcaucauggcgaucgggaucgugagcauccugcuguccagccuccugaagaacgacgucccgcuggccggcccccucaucgccggcgggaugcugaucgccugcuacgugaucagcggcuccagcgccgaccugucccucgagaaggcggccgaggugagcugggagcaggaggccgagcacuccgggaccagccacaacauccuggucgaggugcaggacgacggcaccaugaagaucaaggacgaggagcgcgacgacacgcugaccauccuccugaaggccacccugcucgccguguccggggucuaccccaugagcauccccgcgacccuguucgugugguacuucuggcagaagaagaagcagcgguccggcgugcugugggacacgccguccccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacaccggggaggagguccaggugaucgccguggagccgggcaagaaccccaagaacguccagacgacccccggcaccuucaagacccccgagggggaggugggcgcgaucgcccucgacuucaagccggggacgagcggcucccccaucgugaaccgggagggcaagaucgucgggcuguacggcaacgggguggugaccaccagcggcaccuacgucuccgccaucgcccaggccaaggcgagccaggaggggccccugccggagaucgaggacgagguguucaagaagcgcaaccucacgaucauggaccugcaccccggcagcggcaagacccggcgcuaccugcccgccaucgugcgggaggccaucaagcgcaagcuccggacccugauccuggcccccacccgcgucguggcguccgagauggccgaggcccucaaggggaugccgauccgcuaccagacgaccgccgucaagagcgagcacaccggccgggagaucgucgaccugaugugccacgccaccuucacgaugcgccugcucucccccgugcgggugcccaacuacaacaugaucaucauggacgaggcgcacuucaccgaccccgccagcaucgccgcccgcggguacaucuccacccgggucggcaugggggaggccgcggccaucuucaugaccgccacgccgcccggcagcguggaggccuucccccaguccaacgccgugauccaggacgaggagcgcgacauccccgagcggagcuggaacuccggcuacgacuggaucaccgacuucccggggaagaccgucugguucgugcccagcaucaaguccggcaacgacaucgcgaacugccugcgcaagaacgggaagcgggugauccagcugagccgcaagaccuucgacacggaguaccagaagaccaagaacaacgacugggacuacgucgugaccaccgacaucuccgagaugggcgccaacuuccgggccgaccgcgugaucgacccccggcgcugccucaagcccgucauccugaaggacgggccggagcgggugauccuggccggccccaugcccgugacggucgcgagcgccgcccagcgccggggccgcaucgggcggaaccagaacaaggagggcgaccaguacguguacauggggcagccccucaacaacgacgaggaccacgcccacuggaccgaggccaagaugcugcuggacaacaucaacaccccggagggcaucauccccgcccucuucgagcccgagcgcgagaaguccgccgccaucgacggggaguaccgccugcggggcgaggcccgcaagaccuucgucgagcugaugcggcgcggcgaccuccccguguggcugagcuacaagguggccuccgaggggauccaguacagcgaccggcgcuggugcuucgacggcgagcggaacaaccagguccuggaggagaacauggacguggagaucuggaccaaggagggggagcgcaagaagcuccggccgcgcuggcuggacgcgcggacguacuccgacccccuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacccugaugcugcucgcccugaucgcggugcugacgggcggggugacccucuucuuccugagcggcaagggccuggggaagaccuccaucggccuccugugcgucaccgccagcuccgcccugcucuggauggccagcguggagcugcacuggaucgccgcguccaucauccuggaguucuuccucauggugcugcugaucccggagcccgaccggcagcgcacgccccaggacaaccagcucgccuacgucgugaucgggcugcuguucaugauccucaccguggccgccaacgagaugggccugcuggagaccaccaagaaggaccucgggaucggccacgucgccgcggagaaccaccagcacgccacgaugcuggacguggaccugcggccggccagcgccuggacccucuacgccguggcgaccaccgucaucacgcccaugaugcgccacaccaucgagaacaccaccgccaacaucucccugacggccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacccgggaggcccagaagcgcacggcggccggcaucaugaagaaccccaccguggacggcaucgucgccaucgaccucgaccccgugguguacgacgccaaguucgagaagcagcuggggcagaucaugcugcucauccugugcaccagccagauccugcucaugcgcaccacgugggcccugugcgaguccaucacccuggcgaccggcccgcucaccacgcugugggaggggagccccggcaaguucuggaacaccaccaucgccgucuccauggccaacaucuuccggggcagcuaccuggccggggccggccucgcguucucccugaugaagucccucgggggcgggcgccgggggaccggcgcccagggggagacgcucggcgagaaguggaagcgccagcugaaccagcuguccaagagcgaguucaacaucuacaagcggagcgggaucauggagguggaccgcuccgaggccaaggagggccucaagcgcggggagaccaccaagcacgccgugagccgcggcaccgcgaagcugcggugguucgucgagcgcaaccuggugaagcccgagggcaaggugaucgaccuggggugcggccgcgggggcugguccuacuacugcgccgggcucaagaaggucaccgaggugaagggcuacacgaagggcgggcccggccacgaggagccgauccccauggccaccuacggguggaaccuggugaagcugcacagcggcaaggacgucuucuucaugccgcccgagaagugcgacacccuccugugcgacaucggggaguccagcccgaaccccaccaucgaggagggccgcacgcugcgggugcucaagaugguggagcccuggcugcgcggcaaccaguucugcaucaagauccugaaccccuacaugccguccgucguggagacccucgagcagaugcagcggaagcacgggggcaugcuggugcgcaacccccugagccggaacuccacccacgagauguacugggucagcugcgggaccggcaacaucguguccgccgugaacaugacgagccgcaugcuccugaaccgguucaccauggcccaccgcaagcccaccuacgagcgcgacgucgaccugggcgcggggacccggcacguggccguggagcccgaggucgccaaccucgacaucaucggccagcgcaucgagaacaucaagaacgagcacaaguccacguggcacuacgacgaggacaacccguacaagaccugggccuaccacgggagcuacgaggugaagcccuccggcagcgccuccagcauggugaacggggucgugcggcugcugaccaagcccugggacgucauccccauggugacccagaucgcgaugacggacaccaccccguucggccagcagcgcguguucaaggagaaggucgacacccggacgccccgcgccaagcggggcaccacccagaucauggaggugaccgccaaguggcucuggggguuccugucccgcaacaagaagccccggaucugcacgcgcgaggaguucacccggaaggugcgcagcaacgccgccaucggcgcggucuucguggacgagaaccaguggaacagcgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgccaagaacgggaccgucauggacgugaucucccggcgcgaccagcggggcagcggccagguggggaccuacggccugaacaccuucacgaacauggagguccagcugauccgccagauggaguccgaggggaucuuccuccccagcgagcuggagaccccgaaccuggcggagcgggugcucgacuggcuggagaagcacggcgccgagcgccugaagcggauggccaucuccggggacgacugcguggucaagcccaucgacgaccgcuucgccaccgcccucaccgcgcugaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccuggagcauccacgcgcaccaccaguggaugaccacggaggacaugcucuccguguggaaccggguguggaucgaggagaacccguggauggaggacaagacccacgucagcuccugggaggaggugcccuaccugggcaagcgcgaggaccaguggugcggcagccugaucgggcucaccgcccgcgccaccugggccacgaacauccagguggccaucaaccagguccggcgccugaucggcaacgagaacuaccuggacuacaugaccuccaugaagcgguucaagaacgagagcgaccccgagggggcgcucugguga

SEQ ID NO: 8119 - RNA, 9879 nt, Artificial Sequence
  derived and/or modified CDS sequence (opt1) from DENV-1__KJ189343__SS-prME
agcgugaccaugcugcucaugcugcugcccaccgcccucgccuuccaccugacgacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccgccgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaccgcccuguuccucgcgcacgccaucggcaccagcaucacccagaaggggaucaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugccccacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcguggugaacuggaagggccgcgagcugaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggaggucgaggacuacggcuucgggaucuucaccaccaacaucuggcugaagcuccgcgacuccuacacccagaugugcgaccaccggcugaugagcgcggccaucaaggacuccaaggccgugcacgccgacaugggcuacuggaucgagagcgagaagaacgagacguggaagcuggcccgcgcguccuucaucgaggugaagaccugcaccuggcccaagagccacacccucugguccaacggcguccuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgugguggucgacgagcacugcggcaaccgcgggccgagccuccggacgaccaccgugaccggcaagaucauccacgaguggugcugccgcuccugcacgcugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgccagcaucaugaucgaggaggucaugcggucccgcuggagccggaagaugcucaugaucggcacccuggccguguuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgucggccugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgugccccucgccgggccgcugaucgccggcggcaugcugaucgccugcuacgucaucagcggguccagcgcggaccucucccuggagaagaccgccgaggugagcugggagcaggaggccgagcacuccggcaccagccacaacauccugguggagguccaggacgacgggaccaugaagaucaaggacgaggagcgcgacgacacgcucaccauccugcugaaggccacccuccuggccguguccggcguguaccccaugagcauccccgcgacccuguucgucugguacuucuggcagaagaagaagcagcgguccggggugcucugggacacgcccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagacgacccccggcaccuucaagacccccgagggcgaggucggggcgaucgcccuggacuucaagcccggcacgagcggguccccgaucgugaaccgggagggcaagaucgugggccuguacgggaacggcgucgugaccaccagcgggaccuacguguccgccaucgcccaggccaaggcgagccaggagggcccccuccccgagaucgaggacgaggucuucaagaagcgcaaccugacgaucauggaccugcacccggggagcggcaagacccggcgcuaccuccccgccaucgugcgggaggccaucaagcgcaagcugcggacccugauccucgcccccacccgcguggucgcguccgagauggccgaggcccugaagggcaugcccauccgcuaccagacgaccgccgucaagagcgagcacaccgggcgggagaucguggaccugaugugccacgccaccuucacgaugcgccuccuguccccgguccgggugcccaacuacaacaugaucaucauggacgaggcgcacuucaccgaccccgccagcaucgccgcccgcggcuacaucuccacccggguggggaugggcgaggccgcggccaucuucaugaccgccacgcccccggggagcgucgaggccuucccccaguccaacgccgugauccaggacgaggagcgcgacauccccgagcggagcuggaacuccggcuacgacuggaucaccgacuuccccggcaagaccgugugguucgucccgagcaucaaguccgggaacgacaucgcgaacugccugcgcaagaacggcaagcgggugauccagcucagccgcaagaccuucgacacggaguaccagaagaccaagaacaacgacugggacuacguggucaccaccgacaucuccgagaugggggccaacuuccgggccgaccgcgugaucgacccccggcgcugccugaagcccgugauccugaaggacggccccgagcgggucauccucgccgggccgaugcccgugacgguggcgagcgccgcccagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcgcggacguacuccgacccgcucgcccugcgcgaguucaaggaguucgccgccgggcggcgcagcgugagcggcgaccugauccucgagaucggcaagcugccccagcaccugacccuccgggcccagaacgcgcuggacaaccuggccaugcuccacaacuccgagcagggcgggaaggccuaccgccacgccauggaggagcugcccgacaccaucgagacccugaugcuccuggcgcugaucgccgugcucaccggcggggucacccuguucuuccugagcgggaaggggcucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggcggccgagaaccaccagcacgccacgaugcuggacguggaccugcggccggccagcgccuggacccucuacgcggucgccaccaccgugaucacgcccaugaugcgccacaccaucgagaacaccaccgccaacaucucccugacggccaucgccaaccaggcggccauccugaugggccucgacaagggcuggcccaucagcaagauggacaucggggugccccugcuggcccucggcugcuacucccaggucaacccgcugacccugaccgccgcggugcucaugcugguggcccacuacgccaucaucgggcccggccugcaggccaaggccacccgggaggcgcagaagcgcacggccgccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcgcugugcgaguccaucacccuggccaccgggccgcucaccacgcugugggagggcagccccgggaaguucuggaacaccaccaucgccguguccauggccaacaucuuccggggcagcuaccuggccggcgcggggcucgccuucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgguucaccauggcgcaccgcaagcccaccuucgagcgcgacguggaccugggcgccggcacgcggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgcguccagcauggucaacggcguggugcggcugcugaccaagcccugggacgucauccccauggugacgcagaucgccaugaccgacaccaccccguucgggcagcagcgcgucuucaaggagaagguggacacgcggacgccccgggccaagcggggcaccacccagaucauggaggugacggccaaguggcucuggggcuuccugucccgcaacaagaagccccggaucugcacccgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacacggccgggugggacacccggaucaccgaggacgaccuccagaacgaggccaagaucaccgacaucauggagcccgagcacgcccugcuggccacgagcaucuucaagcucaccuaccagaacaagguggugcgcguccagcgccccgcgaagaacggcaccgugauggacgugaucucccggcgcgaccagcgggggagcggccaggucggcaccuacgggcugaacacguucaccaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagacggccugccugggcaagagcuacgcgcagauguggcagcucauguacuuccaccggcgcgaccugcggcuggccgccaacgccaucugcuccgcggugcccgucgacugggugcccaccagccgcaccaccuggagcauccacgcccaccaccaguggaugacgaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccacgugggccaccaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8120 - RNA, 9879 nt, Artificial Sequence
  derived and/or modified CDS sequence (opt1) from DENV-1__KJ189344__SS-prME
agcgugacgaugcugcucaugcugcugcccaccgcccucgccuuccaccugacgacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaccgcccuguuccucgcgcacgccaucggcaccagcaucacccagaaggggaucaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugccccacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcguggugaacuggaagggccgcgagcugaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggaggucgaggacuacggcuucgggaucuucaccaccaacaucuggcugaagcuccgcgacuccuacacccagaugugcgaccaccggcugaugagcgcggccaucaaggacuccaaggccgugcacgccgacaugggcuacuggaucgagagcgagaagaacgagacguggaagcuggcccgcgcguccuucaucgaggugaagaccugcaccuggcccaagagccacacccucugguccaacggcguccuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgugguggucgacgagcacugcggcaaccgcgggccgagccuccggacgaccaccgugaccggcaagaucauccacgaguggugcugccgcuccugcacgcugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgucagcaucaugaucgaggaggugaugcggucccgcuggagccggaagaugcucaugaccggcacccuggccguguuccugcuccuggucauggggcagcugaccuggaacgaccucauccgccugugcaucauggugggcgccaacgcguccgaccgcauggggaugggcacgaccuaccuggcccucauggccaccuucaagaugcggccgauguucgccgugggccugcuguuccgccggcucaccagccgcgagguccugcugcucacgaucgggcugucccugguggccagcgucgagcuccccaacucccuggaggagcugggcgacgggcucgcgaugggcaucaugaugcugaagcugcucaccgaguuccagccccaccagcuguggaccacccugcucagccugacguucaucaagaccacccugucccucgacuacgccuggaagaccacggccauggcccugagcaucgugucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggcgaucggcaucgucagcauccugcucuccagccugcugaagaacgacgugccccucgccgggccgcugaucgccggcggcaugcugaucgccugcuacgugaucagcggguccagcgccgaccucucccuggagaaggcggccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggccgucuccggcguguaccccaugagcauccccgcgacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagacgacccccggcaccuucaagacccccgagggcgaggugggggcgaucgcccuggacuucaagcccggcacgagcggguccccgaucgucaaccgggagggcaagaucgugggccuguacgggaacggcguggucaccaccagcgggaccuacguguccgccaucgcccaggccaaggcgagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcccccacccgcgugguggcguccgagauggccgaggcccugaagggcaugcccauccgcuaccagacgaccgccgucaagagcgagcacaccgggcgggagaucguggaccugaugugccacgccaccuucacgaugcgccuccuguccccggugcggguccccaacuacaacaugaucaucauggacgaggcgcacuucaccgaccccgccagcaucgccgcccgcggcuacaucuccacccggguggggaugggcgaggccgcggccaucuucaugaccgccacgcccccggggagcguggaggccuucccccaguccaacgccgucauccaggacgaggagcgcgacauccccgagcggagcuggaacuccggcuacgacuggaucaccgacuuccccggcaagaccgugugguucgugccgagcaucaaguccgggaacgacaucgcgaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgccgggccgaugcccgucacgguggcgagcgccgcccagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgucagcggcgaccugauccucgagaucggcaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcggugcucaccggcggggucacccuguucuuccugagcgggaaggggcucggcaagaccuccaucgggcugcugugcgugaccgccagcuccgcccuccuguggauggccagcguggagccccacuggaucgccgcguccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggccgcggagaaccaccagcacgccacgaugcuggacguggaccugcggccggccagcgccuggacccucuacgccgucgcgaccaccgugaucacgcccaugaugcgccacaccaucgagaacaccaccgccaacaucucccugacggccaucgccaaccaggccgcgauccugaugggccucgacaagggcuggcccaucagcaagauggacaucggggugccccugcuggcccucggcugcuacucccaggucaacccgcugacccugaccgccgccgugcucaugcugguggcgcacuacgccaucaucgggcccggccugcaggccaaggccacccgggaggcccagaagcgcacggcggccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggaggcccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcgugguccggcugcugaccaagcccugggacgugauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgagaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8121 - RNA, 9879 nt, Artificial Sequence
  derived and/or modified CDS sequence (opt1) from DENV-1__KJ189346__SS-prME
agcgugaccaugcugcucaugcugcugcccaccgcccucgccuuccaccugaccacccggggcggggagccccacaugaucgugagcaagcaggagcggggcaagagccuccucuucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaugagcggcaccaccaccaucuucgccgggcaccugaagugccggcugaagauggacaagcucacgcugaagggcaccuccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggccuggaacaucugggagguggaggacuacggcuucgggaucuucaccacgaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccucugguccaacggcgugauggagagcgagaugaucauccccaagaucuacgggggcccgaucucccagcacaacuaccggcccggguacuucacccagaccgccggccccuggcaccuggggaagcuggagcucgacuucgaccugugcgagggcacgaccgucgugguggacgagcacugcggcaaccgcgggccgagccugcggaccaccacggucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgccagcaucaugaucgaggaggugaugcggucccgcuggagccggaagaugcugaugaccggcacgcucgccgucuuccugcugcucgugauggggcagcugaccuggaacgaccugauccgccucugcaucauggugggcgcgaacgccuccgaccgcauggggaugggcaccaccuaccuggcccugauggccacguucaagaugcggccgauguucgccgucgggcuccuguuccgccggcugaccagccgcgaggugcuccugcugaccaucgggcucucccugguggcgagcgucgagcugcccaacucccucgaggagcugggcgacgggcuggccaugggcaucaugaugcucaagcugcugaccgaguuccagccccaccagcucuggacgacccugcugagccucaccuucaucaagaccacgcugucccuggacuacgccuggaagaccaccgccauggcgcucagcaucgugucccuguucccccugugccucagcaccacgucccagaagaccaccuggcugccgguccugcucggcagcuucgggugcaagccccugaccauguuccugaucaccgagaacaagaucuggggccggaaguccuggccccucaacgaggggaucauggccaucggcaucgugagcauccugcuguccagccuccugaagaacgacgugccccuggccgggccgcucaucgccggcggcaugcugaucgccugcuacgucaucagcggguccagcgcggaccugucccucgagaaggccgccgaggugagcugggagcaggaggccgagcacuccggcacgagccacaacauccugguggagguccaggacgacgggaccaugaagaucaaggacgaggagcgcgacgacacccugaccauccuccugaaggccacgcugcucgcgguguccggcguguaccccaugagcauccccgccacccuguuccugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacgcgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacccccggcacguucaagacccccgagggcgaggugggggccaucgcccuggacuucaagcccggcaccagcggguccccgaucgucaaccgggagggcaagaucgugggccuguacgggaacggcguggucaccacgagcgggaccuacguguccgccaucgcccaggcgaaggccagccaggagggcccccuccccgagaucgaggacgagguguucaagaagcgcaaccugaccaucauggaccugcacccggggagcggcaagacccggcgcuaccuccccgccaucguccgggaggccaucaagcgcaagcugcggacgcugauccucgcgcccacccgcgugguggccuccgagauggccgaggcccugaagggcaugcccauccgcuaccagaccaccgccgucaagagcgagcacacggggcgggagaucguggaccugaugugccacgcgaccuucaccaugcgccuccuguccccggugcggguccccaacuacaacaugaucaucauggacgaggcccacuucaccgaccccgccagcaucgccgcccgcggcuacaucuccacgcggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucaccgacuuccccggcaagacggugugguucgugcccagcaucaaguccgggaacgacaucgccaacugccugcgcaagaacggcaagcgggucauccagcucagccgcaagaccuucgacaccgaguaccagaagaccaagaacaacgacugggacuacguggugacgaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugaccucccgggcgcagaacgcccucgacaaccuggugaugcugcacaacagcgagcagggcgggaaggccuaccgccacgccauggaggagcuccccgacacgaucgagacccugaugcugcucgcgcugaucgccgugcugaccgggggcgucacccucuucuuccuguccgggaagggccugggcaagacgagcaucgggcuccugugcgugaccgccuccagcgcccugcucuggauggccuccguggagccccacuggaucgcggccagcaucauccuggaguucuuccugaugguccuccugaucccggagcccgaccggcagcgcacgccccaggacaaccagcuggccuacguggugaucggccuccuguucaugauccugaccgucgccgccaacgagauggggcuccuggagacgaccaagaaggaccugggcaucgggcacguggcggccgagaaccaccagcacgccaccaugcucgacguggaccugcggccggccuccgccuggacccuguacgcggucgccacgaccgugaucacccccaugaugcgccacaccaucgagaacacgaccgccaacaucagccucaccgccaucgccaaccaggcggccauccugaugggccuggacaagggcuggcccaucuccaagauggacaucggggugccccuccuggcccugggcugcuacagccaggucaacccgcucacccugacggccgcggugcugaugcucguggcccacuacgccaucaucgggcccggccugcaggccaaggccacccgggaggcgcagaagcgcaccgccgccgggaucaugaagaaccccaccgucgacggcaucguggccaucgaccuggaccccguggucuacgacgccaaguucgagaagcagcucggccagaucaugcugcugauccucugcacgucccagauccugcugaugcgcaccaccugggcgcucugcgagagcaucacccuggccacggggccgcugaccacccucugggagggcucccccgggaaguucuggaacaccacgaucgccgugagcauggccaacaucuuccggggcuccuaccuggccggcgcggggcuggccuucagccucaugaagucccugggcgggggccgccgggggaccggcgcccagggcgagacccugggggagaaguggaagcgccagcucaaccagcugagcaagagcgaguucaacaccuacaagcgguccggcaucauggagguggaccgcagcgaggccaaggaggggcugaagcggggcgagacgaccaagcacgcggucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagccgauccccauggccacguacggcuggaaccucgccaagcugcacuccgggaaggacgucuucuucaugccgcccgagaagugcgacacccugcucugcgacaucggcgagagcuccccgaaccccaccaucgaggaggggcgcacccugcgggugcugaagaugguggagcccuggcuccgcggcaaccaguucugcaucaagauccugaaccccuacaugccgagcgucguggagacgcuggagcagaugcagcggaagcacggcgggaugcucgugcgcaacccccugucccggaacagcacccacgagauguacugggucuccugcggcaccgggaacaucgugagcgcggugaacaugaccucccgcaugcugcucaaccgguucacgaccgcccaccgcaagcccaccuacgagcgcgacgucgaccugggcgccggcacccggcacguggccguggagcccgaggucgccaaccuggacaucaucgggcagcgcaucgagaacaucaagaacgagcacaagagcacguggcacuacgacgaggacaacccguacaagaccugggcguaccacggcuccuacgaggugaagcccagcggguccgccagcuccauggugaacggcgucgugcggcuccugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcuguggggcuuccucagccgcaacaagaagccccggaucugcacgcgcgaggaguucacccggaaggugcgcagcaacgcggccaucggggccgucuucguggacgagaaccaguggaacuccgccaaggaggcgguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacaccgccgggugggacacgcggaucaccgaggacgaccugcagaacgaggccaagaucaccgagaucauggagcccgagcacgcccuccuggcgaccuccaucuucaagcugacguaccagaacaaggucgugcgcgugcagcgccccgccaagaacggcaccgucauggacgugaucagccggcgcgaccagcggggguccggccaggugggcaccuacgggcucaacaccuucacgaacauggagguccagcugauccgccagauggagagcgagggcaucuuccugcccuccgagcucgagaccccgaaccuggccgagcgggugcuggacuggcucgagaagcacggggccgagcgccugaagcggauggccaucagcggcgacgacugcguggucaagcccaucgacgaccgcuucgcgaccgcccugaccgcccucaacgacauggggaaggugcggaaggacauccugcagugggagcccuccaagggcuggaacgacuggcagcagguccccuucugcagccaccacuuccaccagcugaucaugaaggacggccgcgagaucgucgugccgugccggaaccaggacgagcucguggggcgcgcccgggucucccagggcgccggguggagccugcgcgagaccgcgugccugggcaaguccuacgcccagauguggcagcucauguacuuccaccggcgcgaccugcggcuggccgccaacgcgaucugcagcgccgugcccguggacuggguccccacgagccgcaccaccugguccauccacgcccaccaccaguggaugaccacggaggacaugcucagcguguggaaccggguguggaucgaggagaaccccuggauggaggacaagacccacgucuccagcugggaggaggugccguaccuggggaagcgcgaggaccaguggugcggcucccugaucggccucaccgcccgcgccaccugggcgacgaacauccagguggccaucaaccagguccggcgccugaucgggaacgagaacuaccuggacuacaugaccagcaugaagcgguucaagaacgaguccgaccccgagggcgcccucugguga

SEQ ID NO: 8122 - RNA, 9879 nt, Artificial Sequence
  derived and/or modified CDS sequence (opt1) from DENV-1__KJ189347__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcagcgagggcgccuggaagcagauccagcgcguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggcccuucaagcuggagaaggaggucgcggagacgcagcacggcaccgugcuggugcaggucaaguacgagggcaccgacgcccccugcaagaucccguuccucacccaggacgagaagggggugacgcagaacggccgccugaucaccgccaaccccaucgugaccgacaaggagaagcccgucaacaucgagaccgagcccccguucggggagagcuacaucguggugggcgccggcgagaaggcgcugaagcucuccugguucaagaaggggagcuccaucggcaagauguucgaggccacggcccgcggggcccgccggauggccauccugggcgacaccgcgugggacuucgggagcaucggcggcgucuucaccuccguggggaagcuggugcaccaggucuucggcaccgccuacgggguccuguucagcggcguguccuggacgaugaagaucgggaucggcauccugcugaccuggcucggccugaacagccgcuccaccagccuguccaugaccugcaucgccgucgggauggugacgcucuaccugggcgugaugguccaggccgacagcgggugcgugaucaacuggaagggccgcgagcugaagugcggguccggcaucuucgugaccaacgagguccacaccuggaccgagcaguacaaguuccaggccgacagccccaagcggcucuccgcggccaucggcaaggccugggaggagggggugugcggcauccgcagcgccacccggcuggagaacaucauguggaagcagaucagcaacgagcugaaccacauccuccuggagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggccggacacccccgagugccccgacaaccagcgggccuggaacaucugggagguggaggacuacggcuucgggaucuucacgaccaacaucuggcucaagcugcgcgacuccuacacccagaugugcgaccaccggcugaugagcgcggccaucaaggacuccaaggccguccacgccgacaugggcuacuggaucgagagcgagaagaacgagaccuggaagcucgcccgcgcguccuucaucgaggugaagacgugcaccuggcccaagagccacacccugugguccaacggcgugcuggagagcgagaugaucaucccgaagaucuacgggggccccaucucccagcacaacuaccggcccggguacuucacccagacggccggcccguggcaccucgggaagcuggagcuggacuucgaccucugcgagggcaccaccgucgugguggacgagcacugcggcaaccgcgggcccagccugcggaccacgaccgucaccggcaagaucauccacgaguggugcugccgcuccugcacccugccgccccuccgguuccgcggggaggacggcugcugguacgggauggagauccggccggugaaggagaaggaggagaaccuggugcgcagcauggucuccgccggcagcggcgagguggacuccuucagccuggggauccucugcgugagcaucaugaucgaggaggucaugcggucccgcuggagccggaagaugcugaugacgggcacccuggccguguuccuccugcuggugauggggcagcucaccuggaacgaccugauccgccugugcaucauggucggcgccaacgcguccgaccgcauggggaugggcaccacguaccucgcccugauggccaccuucaagaugcggcccauguucgccguggggcuccucuuccgccggcugaccagccgcgaggugcugcuccugaccaucgggcugucccucauggccagcgucgagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgugucccucuucccgcugugccugagcacgaccucccagaagaccaccuggcuccccguccugcugggcagcuucgggugcaagccccucaccauguuccugaucacggagaacaagaucuggggccggaaguccuggccccugaacgaggggaucauggcgaucggcaucgugagcauccuccuguccagccugcucaagaacgacgugccgcuggccgggccccugaucgccggcggcaugcucaucgccugcuacgucaucuccgggagcagcgccgaccugucccuggagaaggcggccgaggugagcugggagcaggaggccgagcacuccggcaccagccacaacauccucguggagguccaggacgacgggaccaugaagaucaaggacgaggagcgcgacgacacccugacgauccugcucaaggccacccugcuggccguguccggcguguaccccaugagcauccccgcgacccucuucgucugguacuucuggcagaagaagaagcagcgguccggggugcugugggacaccccguccccgcccgagguggagcgcgccguccuggacgacggcaucuaccggauccugcagcgcggccuccuggggcggucccaggugggcgugggggucuuccaggacggcguguuccacacgauguggcacgugacccgcggggccguccugauguaccagggcaagcggcucgagcccagcugggccuccgugaagaaggaccugaucagcuacggcgggggcuggcgcuuccagggguccuggaacaccggcgaggaggugcaggucaucgccguggagccggggaagaaccccaagaacgugcagaccacgcccggcaccuucaagacccccgagggcgaggucggggcgaucgcccuggacuucaagccgggcaccagcgggucccccaucgugaaccgggagggcaagaucgugggccucuacgggaacggcgucgugacgaccagcgggaccuacguguccgccaucgcccaggccaaggcgagccaggagggcccccugccggagaucgaggacgaggucuucaagaagcgcaaccugaccaucauggaccuccaccccggguccggcaagacgcggcgcuaccugcccgccaucgugcgggaggccaucaagcgcaagcugcggacccucauccuggcccccacccgcguggucgcgagcgagauggccgaggcccugaagggcaugccgauccgcuaccagaccacggccgucaagagcgagcacaccgggcgggagaucguggaccucaugugccacgccaccuucaccaugcgccugcugucccccguccgggugcccaacuacaacaugaucaucauggacgaggcgcacuucacggaccccgccagcaucgccgcccgcggcuacaucuccacccggguggggaugggcgaggccgcggccaucuucaugaccgccaccccgcccgggagcgucgaggccuucccccaguccaacgccgugauccaggacgaggagcgcgacauccccgagcggagcuggaacuccggcuacgacuggaucacggacuucccgggcaagaccgugugguucguccccagcaucaaguccgggaacgacaucgcgaacugccuccgcaagaacggcaagcgggugauccagcugagccgcaagaccuucgacaccgaguaccagaagacgaagaacaacgacugggacuacguggucaccaccgacaucuccgagaugggggccaacuuccgggccgaccgcgugaucgacccccggcgcugccugaagcccgugauccucaaggacggcccggagcgggucauccuggccgggcccaugcccgugaccguggcgagcgccgcccagcgccggggccgcaucggccggaaccagaacaaggagggggaccaguacgucuacaugggccagccccugaacaacgacgaggaccacgcccacuggacggaggccaagaugcuccuggacaacaucaacaccccggaggggaucauccccgcgcuguucgagcccgagcgcgagaaguccgccgccaucgacggcgaguaccgccuccgcggggaggcccgcaagaccuucguggagcugaugcggcgcggcgaccugcccgucuggcucagcuacaagguggccuccgagggcuuccaguacagcgaccggcgcuggugcuucgacggggagcggaacaaccaggugcuggaggagaacauggacgucgagaucuggaccaaggagggcgagcgcaagaagcugcggccgcgcuggcucgacgcgcggaccuacuccgacccccuggcccugcgcgaguucaaggaguucgccgccgggcggcgcagcguguccggcgaccucauccuggagaucggcaagcugccccagcaccucacgcugcgggcccagaacgcgcuggacaaccucgugaugcugcacaacagcgagcagggcgggaaggccuaccgccacgccauggaggagcugcccgacaccaucgagacccucaugcugcuggcccucaucgcgguccugaccgggggcgugacgcuguucuuccucagcgggaagggccugggcaagaccuccaucgggcugcucugcgugaccgccagcuccgcccugcuguggauggccagcgucgagccgcacuggaucgccgcguccaucauccucgaguucuuccugauggugcugcucauccccgagcccgaccggcagcgcaccccgcaggacaaccagcuggccuacguggucaucggccuccucuucaugauccugacgguggccgccaacgagauggggcugcucgagaccaccaagaaggaccugggcaucgggcacguggccgcggagaaccaccagcacgccaccaugcuggacgucgaccuccggcccgccagcgccuggacgcuguacgccguggcgaccaccgugaucacccccaugaugcgccacacgaucgagaacaccaccgccaacaucucccugaccgccaucgccaaccaggccgcgauccucaugggccuggacaagggcuggcccaucagcaagauggacaucggggucccgcugcucgcccugggcugcuacucccaggugaacccccugacgcucaccgccgccgugcugaugcuggucgcgcacuacgccaucaucgggcccggccuccaggccaaggccacccgggaggcccagaagcgcaccgcggccgggaucaugaagaaccccacgguggacggcaucguggccaucgaccuggacccggucguguacgacgccaaguucgagaagcagcugggccagaucaugcuccugauccugugcaccagccagauccuccugaugcgcaccaccugggcccugugcgaguccaucacgcucgcgaccgggccccugaccacccugugggagggcagccccgggaaguucuggaacacgaccaucgccguguccauggccaacaucuuccggggcagcuaccucgccggcgccgggcuggcguucucccugaugaagucccucggcgggggccgccgggggaccggcgcccagggcgagacccugggggagaaguggaagcgccagcugaaccagcucuccaagagcgaguucaacacguacaagcgguccggcaucauggaggucgaccgcagcgaggccaaggaggggcugaagcggggcgagaccaccaagcacgccgugagccgcgggaccgcgaagcugcggugguucguggagcgcaaccuggucaagcccgagggcaaggugaucgaccucggcugcgggcggggcgggugguccuacuacugcgccggccugaagaaggugaccgaggucaagggguacacgaagggcggcccggggcacgaggagcccauccccauggccaccuacggcuggaaccuggugaagcuccacagcgggaaggacguguucuucaugcccccggagaagugcgacacccugcugugcgacaucggcgaguccagccccaaccccaccaucgaggaggggcgcacgcuccggguccugaagaugguggagcccuggcugcgcggcaaccaguucugcaucaagauccucaacccguacaugcccuccguggucgagacccuggagcagaugcagcggaagcacggcgggaugcuggugcgcaacccccucagccggaacuccacccacgagauguacugggugagcugcggcaccgggaacaucgucuccgccgugaacaugacgagccgcaugcugcugaaccgguucaccauggcccaccgcaagcccaccuacgagcgcgacguggaccucggcgcgggcacccggcacgucgccguggagccggagguggccaaccuggacaucaucgggcagcgcaucgagaacaucaagaacgagcacaaguccacguggcacuacgacgaggacaaccccuacaagaccugggccuaccacggcagcuacgagguccggcccuccgggagcgccuccagcauggugaacggcgugguccgccugcucaccaagcccugggacgugaucccgauggucacccagaucgcgaugacggacaccacccccuucgggcagcagcggguguucaaggagaagguggacacccgcacgccccgggccaagcgcggcaccacccagaucauggaggucaccgccaaguggcuguggggcuuccugucccggaacaagaagccgcgcaucugcacgcgggaggaguucacccgcaaggugcggagcaacgccgccaucggggcgguguucgucgacgagaaccaguggaacuccgccaaggaggccguggaggacgagcgcuucugggaccucgugcaccgggagcgcgagcugcacaagcagggccggugcgcgaccugcgucuacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacaccgcggggugggacacgcgcaucaccgaggacgaccugcagaacgaggccaagaucaccgagaucauggagcccgagcacgcccugcucgccaccagcaucuucaagcugacguaccagaacaaggugguccgggugcagcgccccgccaagaacggcaccgugauggacgucaucucccggcgcgaccagcgggggagcggccaggugggcaccuacgggcugaacaccuucacgaacauggaggugcagcucauccgccagauggaguccgagggcaucuuccugccgagcgagcuggagacccccaaccucgcggagcggguccuggacuggcuggagaagcacggggccgagcgccucaagcggauggccaucuccggcgacgacugcguggugaagcccaucgacgaccgcuucgccaccgcccugaccgcgcugaacgacauggggaagguccggaaggacaucccccagugggagccgagcaagggcuggaacgacuggcagcagguccccuucugcucccaccacuuccaccagcucaucaugaaggacggccgcgagaucgugguccccugccggaaccaggacgagcugguggggcgcgcccgggugagccagggcgccggguggucccugcgcgagaccgccugccucggcaagagcuacgcccagauguggcagcugauguacuuccaccggcgcgaccugcggcucgcggccaacgccaucugcuccgccguccccguggacugggugccgacgagccgcaccaccugguccauccacgcgcaccaccaguggaugaccacggaggacaugcugagcgucuggaaccgcguguggaucgaggagaaccccuggauggaggacaagacccacgugagcuccugggaggagguccccuaccuggggaagcgggaggaccaguggugcggcagccucaucggccugaccgcccgcgccaccugggccacgaacauccagguggccaucaaccaggugcggcgccugaucgggaacgagaacuaccucgacuacaugaccuccaugaagcgguucaagaacgagagcgaccccgagggcgcgcugugguga

SEQ ID NO: 8123 - RNA, 9879 nt, Artificial Sequence
  derived and/or modified CDS sequence (opt1) from DENV-1__KJ189348__SS-prME
agcgugaccaugcugcucaugcugcugcccaccgcccucgccuuccaccugaccacccggggcggggagccgcacaugaucgugagcaagcacgagcggggcaagagccuccucuucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccggcucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagcuucuccaugaccugcaucgccguggggauggugacgcuguaccugggcgucauggugcaggccgacagcgggugcgugaucaacuggaagggccgggagcucaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucacggucguggugggggacgccaacggcauccucgcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagacgugcaccuggcccaagagccacacccugugguccaacggcguccucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgugguggucgacgagcacugcggcaaccgggggccgagccugcgcaccacgaccgugaccggcaagaucauccacgaguggugcugccgguccugcacccugccgccccugcgcuuccgcggggaggacggcugcugguacgggauggagauccgccccgugaaggagaaggaggagaaccugguccggagcaugguguccgccggcagcggcgagguggacagcuucucccucgggauccugugcgucagcaucaugaucgaggaggugaugcgcucccgguggagccgcaagaugcugaugacgggcacccucgccguguuccugcugcucaucauggggcagcugaccuggaacgaccugauccgccucugcaucauggucggcgccaacgcguccgaccggauggggaugggcaccacguaccuggcccugauggccaccuucaagaugcgcccgauguucgccguggggauccucuuccggcgccugaccagccgggaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuucccccugugccugagcacgaccucccagaagaccaccuggcucccggugcugcugggcagcuucgggugcaagccccucaccauguuccugaucacggagaacaagaucuggggccgcaaguccuggcccaucaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugcggaucaaggacgaggagaaggacgacacccucacgauccugcugaaggccacccuccuggccguguccggcgucuaccccaugagcauccccgcgacccuguucgugugguacuucuggcagaagaagaagcagcgcuccggggugcucugggacacccccagcccgcccgaggucgagcgggccgugcuggacgacggcaucuaccgcauccugcagcggggccuccuggggcgcucccaggugggcgucgggguguuccaggacggcguguuccacacgauguggcacgucacccgcggggccgugcugauguaccagggcaagcgccuggagcccagcugggccuccgugaagaaggaccucaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccuccccgagaucgaggacgagguguucaagaagcggaaccugaccaucauggaccugcacccggggagcggcaagacgcgccgguaccuccccgccaucgugcgcgaggccaucaagcggaagcugcgcacccugauccucgcccccacccgcgucguggcguccgagauggccgaggcccugaagggcaugcccauccgguaccagaccacggccgucaagagcgagcacaccgggcgcgagaucgucgaccugaugugccacgccaccuucaccaugcggcuccuguccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcucagccggaagaccuucgacaccgaguaccagaagacgaagaacaacgacugggacuacgucgugaccaccgacaucuccgagaugggggccaacuuccgcgccgaccgggugaucgacccccgccggugccugaagcccgucauccugaaggacggccccgagcgcgugauccucgccgggccgaugcccgugaccgucgcgagcgccgcccagcggcgcggccggaucggccgcaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcgcgcaccuacuccgacccgcucgcccugcgggaguucaaggaguucgccgccgggcgccggagcgugagcggcgaccugauccucgagaucggcaagcugccccagcaccugacgcuccgcgcccagaacgcgcuggacaaccuggucaugcuccacaacuccgagcagggcgggaaggccuaccggcacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucggccugcuguucaugauccucacgguggccgccaacgagauggggcugcuggagaccaccaagcgcgaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgcgaggcccagaagcggaccgcggccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagcccgaguucaacacguacaagcggagcggcaucauggagguggaccgcagcgaggccaaggaggggcucaagcggggcgagaccaccaagcacgccgugucccgcgggaccgcgaagcugcggugguucgucgagcgcaaccuggugaagcccgagggcaaggugaucgaccucggcugcgggcggggcggguggagcuacuacugcgccggccugaagaaggucaccgaggugaagggguacacgaagggcggcccggggcacgaggagcccauccccauggccaccuacggcuggaaccuggugaagcugcacuccgggaaggacgucuucuucaugcccccggagaagugcgacacccuccugugcgacaucggcgagagcucccccaaccccaccaucgaggaggggcgcacgcugcgggugcucaagaugguggagcccuggcugcgcggcaaccaguucugcaucaagauccugaacccguacaugcccagcgucguggagacccucgagcagaugcagcggaagcacggcgggaugcuggugcgcaacccccugucccggaacagcacccacgagauguacugggucuccugcggcaccgggaacaucgugagcgccgugaacaugacgucccgcaugcuccugaaccgcuucaccauggcccaccggaagcccaccuacgagcgcgacgucgaccugggcgcgggcacccggcacguggccguggagccggaggucgccaaccucgacaucaucgggcagcgcaucgagaacaucaagaacgagcacaagagcacguggcacuacgacgaggacaaccccuacaagaccugggccuaccacggcuccuacgaggugaagcccagcggguccgccagcuccauggugaacggcgucgugcggcugcugaccaagcccugggacgucaucccgauggugacccagaucgcgaugacggacaccacccccuucgggcagcagcgcguguucaaggagaaggucgacacccggacgccccgcgccaagcggggcaccacccagaucauggaggugaccgccaaguggcucuggggcuuccugagccgcaacaagaagccgcggaucugcacgcgcgaggaguucacccggaaggugcgcuccaacgccgccaucggggcggucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgccgacgacaccgcggggugggacacgcgcaucaccgaggacgaccuccagaacgaggccaagaucaccgacaucauggagcccgagcacgcccugcuggccaccuccaucuucaagcucacguaccagaacaaggucgugcgggugcagcgccccgccaagaacggcaccgucauggacgugaucagccggcgcgaccagcggggguccggccaggugggcaccuacgggcugaacaccuucacgaacauggagguccagcugauccgccagauggagagcgagggcaucuuccucccguccgagcuggagacccccaaccuggcggagcgggugcucaacuggcuggagaagcacggggccgagcgccugaagcggauggccaucagcggcgacgacugcguggucaagcccaucgacgaccgcuucgccaccgcccucaccgcgcugaacgacauggggaaggugcggaaggacaucccccagugggagccguccaagggcuggaacgacuggcagcagguccccuucugcagccaccacuuccaccagcugaucaugaaggacggccgcgagaucgucgugcccugccggaaccaggacgagcucguggggcgcgcccgggucucccagggcgccggguggagccugcgcgagaccgccugccugggcaaguccuacgcccagauguggcagcucauguacuuccaccggcgcgaccugcggcuggcggccaacgccaucugcagcgccgugcccguggacugggucccgacgucccgcaccaccuggagcauccacgcgcaccaccaguggaugaccacggaggacaugcucagcguguggaaccgcguguggaucgaggagaaccccuggauggaggacaagacccacgucuccagcugggaggaggugcccuaccuggggaagcgggaggaccaguggugcggcucccugaucggccucaccgcccgcgccaccugggccacgaacauccagguggccaucaaccagguccggcgccugaucgggaacgagaacuaccuggacuacaugaccagcaugaagcgguucaagaacgaguccgaccccgagggcgcgcucugguga

SEQ ID NO: 8124 - RNA, 9879 nt, Artificial Sequence
  derived and/or modified CDS sequence (opt1) from DENV-1__KJ189368__SS-prME
agcgugaccaugcugcucaugcugcugcccaccgcccucgccuuccaccugaccacccggggcggggagccccacaugaucguguccaagcaggagcggggcaagagccuccuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacacgugggucaccuacgggaccugcagccagaacggcgagcaccgccgggacaagcgcuccguggcccuggcgccccacgugggccuggggcucgagacccggacggagaccuggaugagcuccgagggcgccuggaagcagauccagcgcgucgagaccugggcccugcggcaccccggguucaccgugaucgcccuguuccucgcgcacgccaucggcacgagcaucacccagaaggggaucaucuucauccugcugaugcucgugacccccuccauggccaugcgcugcgucggcaucggcaaccgggacuucguggaggggcugagcggcgccaccuggguggacgucgugcuggagcacggguccugcgugacgaccauggccaagaacaagcccacccucgacaucgagcugcugaagaccgaggucacgaaccccgcgauccuccgcaagcugugcaucgaggccaagaucagcaacaccaccaccgacucccggugcccgacgcagggcgaggccacccugguggaggagcaggacgccaacuucgugugccgccggaccuucgucgaccgcggcugggggaacggcugcggccucuucggcaaggggagccugcugaccugcgccaaguucaagugcgugacgaagcucgagggcaagaucgugcaguacgagaaccugaaguacuccgucaucgugaccgugcacaccggcgaccagcaccaggucgggaacgagaccacggagcacggcaccaucgcgaccaucacgccccaggcccccaccagcgagauccagcugacggacuacggggcccucacccuggacugcagcccccggaccggccuggacuucaacgagauggugcuccugaccaugaaggagaaguccuggcugguccacaagcagugguuccucgaccugccgcugcccuggacguccggggccagcaccagccaggagaccuggaaccgccaggaccuccuggugaccuucaagacggcccacgcgaagaagcaggagguggucgugcugggcucccaggagggcgccaugcacaccgcccucaccggggccaccgagauccagacgagcggcaccaccaccaucuucgccgggcaccugaagugccggcugaagauggacaagcucacgcugaagggcaccuccuacgugaugugcaccgggcccuucaagcuggagaaggaggucgcggagacccagcacggcacggugcuggugcaggucaaguacgagggcaccgacgcccccugcaagaucccguucagcacccaggacgagaagggggugacccagaacggccgccucaucacggccaaccccaucgugaccgacaaggagaagcccgucaacaucgagaccgagcccccguucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcaccgccuacggggugcuguucuccggcgugagcuggaccaugaagaucgggaucggcauccuccugacguggcugggccucaacucccgcagcaccucccugagcaugaccugcaucgccgucgggauggugacccuguaccucggcgugaugguccaggccgacuccgggugcgugaucaacuggaagggccgcgagcugaagugcgggagcggcaucuucgugacgaacgagguccacaccuggaccgagcaguacaaguuccaggccgacucccccaagcggcugagcgcggccaucggcaaggccugggaggagggggugugcggcauccgcagcgccacccggcucgagaacaucauguggaagcagaucuccaacgagcugaaccacauccugcucgagaacgacaugaaguucaccguggucgugggggacgccaacggcauccuggcgcaggggaagaagaugauccgcccccagcccauggagcacaaguacagcuggaaguccuggggcaaggccaagaucaucggcgccgacauccagaacacgaccuucaucaucgacgggccggacacccccgagugccccgacaaccagcgggccuggaacaucugggagguggaggacuacggcuucgggaucuucaccacgaacaucuggcugaagcuccgcgacagcuacacccagaugugcgaccaccggcugauguccgcggccaucaaggacagcaaggccguccacgccgacaugggcuacuggaucgaguccgagaagaacgagaccuggaagcuggcccgcgcgagcuucaucgaggugaagaccugcacguggcccaagucccacacccucuggagcaacggcgugcuggaguccgagaugaucaucccgaagaucuacgggggccccaucagccagcacaacuaccggcccggguacuucacccagaccgccggcccguggcaccuggggaagcucgagcuggacuucgaccugugcgagggcacgaccgucgugguggacgagcacugcggcaaccgcgggcccucccuccggaccaccacggucaccggcaagaucauccacgaguggugcugccgcagcugcacccugccgccccugcgguuccgcggggaggacggcugcugguacgggauggagauccggccggugaaggagaaggaggagaaccucgugcgcuccauggucagcgccggcuccggcgagguggacagcuucagccuggggauccugugcguguccaucaugaucgaggaggucaugcggagccgcuggucccggaagaugcucaugaccggcacgcuggccguguuccugcuccuggugauggggcagcugaccuggaacgaccucauccgccugugcaucauggucggcgccaacgcgagcgaccgcauggggaugggcaccaccuaccuggcccucauggccacguucaagaugcggcccauguucgccguggggcugcuguuccgccggcucaccucccgcgaggugcugcugcucaccaucgggcugagccuggucgccuccguggagcuccccaacagccuggaggagcugggcgacgggcucgcgaugggcaucaugaugcugaagcugcucaccgaguuccagccccaccagcuguggacgacccugcucucccugaccuucaucaagaccacgcugagccucgacuacgccuggaagaccaccgccauggcccuguccaucgucagccuguucccgcucugccuguccaccacgagccagaagaccaccuggcugcccgugcuccugggcuccuucgggugcaagccccugaccauguuccucaucaccgagaacaagaucuggggccgcaagagcuggccccugaacgaggggaucauggcgaucggcaucguguccauccugcucagcucccugcugaagaacgacgucccgcucgccgggccccugaucgccggcggcaugcugaucgccugcuacgugaucagcgggagcuccgccgaccucagccuggagaaggcggccgagguguccugggagcaggaggccgagcacagcggcacgucccacaacauccuggucgaggugcaggacgacgggaccaugaagaucaaggacgaggagcgggacgacacccucaccauccugcugaaggccacgcuccuggccgugagcggcgucuaccccauguccauccccgcgacccuguucgugugguacuucuggcagaagaagaagcagcggagcggggugcucugggacaccccgagcccgcccgaggucgagcgcgccgugcuggacgacggcaucuaccggauccugcagcgcggccugcucgggcggagccaggugggcgucgggguguuccaggacggcguguuccacaccauguggcacgucacgcgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagccggggaagaaccccaagaacguccagaccacccccggcacguucaagacccccgagggcgaggugggggcgaucgcccuggacuucaagccgggcaccuccgggagccccaucgugaaccgggagggcaagaucgucggccuguacgggaacggcguggugaccacguccgggaccuacgucagcgccaucgcccaggccaaggcgucccaggagggcccccucccggagaucgaggacgagguguucaagaagcgcaaccugaccaucauggaccugcaccccgggagcggcaagacccggcgcuaccuccccgccaucgugcgggaggccaucaagcgcaagcugcggacgcugauccucgcccccacccgcgucguggcgagcgagauggccgaggcccugaagggcaugccgauccgcuaccagaccaccgccgugaaguccgagcacacggggcgggagaucgucgaccugaugugccacgccaccuucaccaugcgccuccugagccccgugcgggugcccaacuacaacaugaucaucauggacgaggcgcacuucaccgaccccgccuccaucgccgcccgcggcuacaucagcacgcgggucgggaugggcgaggccgcggccaucuucaugaccgccaccccgcccggguccguggaggccuucccccagagcaacgccgugauccaggacgaggagcgcgacauccccgagcgguccuggaacagcggcuacgacuggaucaccgacuucccgggcaagacggucugguucgugcccuccaucaagagcgggaacgacaucgcgaacugccugcgcaagaacggcaagcgggugauccagcucucccgcaagaccuucgacaccgaguaccagaagaccaagaacaacgacugggacuacgucgugacgaccgacaucagcgagaugggggccaacuuccgggccgaccgcgugaucgacccccggcgcugccugaagcccgucauccugaaggacggcccggagcgggugauccucgccgggcccaugcccgugaccgucgcguccgccgcccagcgccggggccgcaucggccggaaccagaacaaggagggggaccaguacguguacaugggccagccccugaacaacgacgaggaccacgcccacuggaccgaggccaagaugcugcucgacaacaucaacacgccggaggggaucauccccgcgcuguucgagcccgagcgcgagaaguccgccgccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccgcgcuggcuggacgcgcggaccuacagcgacccccucgcccugcgcgaguucaaggaguucgccgccgggcggcgcuccaucagcggcgaccugauccucgagaucggcaagcugccccagcaccugacccuccgggcccagaacgcgcuggacaaccuggugaugcuccacaacagcgagcagggcgggaaggccuaccgccacgccauggaggagcugcccgacacgaucgagacccugaugcuccuggcccugaucgcgguccucaccgggggcgugacccuguucuuccuguccgggaagggccucggcaagacgagcaucgggcugcugugcgugaccgccuccagcgcccuccuguggauggccuccgucgagccgcacuggaucgccgcgagcaucauccuggaguucuuccucauggugcugcugauccccgagcccgaccggcagcgcaccccgcaggacaaccagcucgccuacguggucaucggccugcuguucaugauccucaccguggccgccaacgagauggggcugcuggagacgaccaagaaggaccucggcaucgggcacguggccgcggagaaccaccagcacgccaccaugcuggacgucgaccugcggcccgccuccgccuggacccucuacgccguggcgacgaccgugaucacccccaugaugcgccacaccaucgagaacacgaccgccaacaucagccugaccgccaucgccaaccaggccgcgauccugaugggccucgacaagggcuggcccaucuccaagauggacaucggggucccgcugcuggcccucggcugcuacagccaggugaacccccugacccugacggccgccgugcucaugcuggucgcgcacuacgccaucaucgggcccggccugcaggccaaggccacccgggaggcccagaagcgcaccgcggccgggaucaugaagaaccccaccguggacggcaucguggccaucgaccucgacccggucguguacgacgccaaguucgagaagcagcugggccagaucaugcugcucauccugugcacgucccagauccugcucaugcgcaccaccugggcccugugcgagagcaucacccuggcgacggggccccucaccacccugugggagggcucccccgggaaguucuggaacaccacgaucgccgugagcauggccaacaucuuccggggcuccuaccuggccggcgccgggcucgcguucagccugaugaagucccugggcgggggccgccgggggaccggcgcccagggcgagacccucggggagaaguggaagcgccagcugaaccagcugagcaaguccgaguucaacaccuacaagcggagcggcaucauggaggucgaccgcagcgaggccaaggaggggcucaagcggggcgagacgaccaagcacgccgugucccgcgggaccgcgaagcugcggugguucguggagcgcaaccuggucaagcccgagggcaaggugaucgaccugggcugcgggcggggcggguggagcuacuacugcgccggccucaagaaggugaccgaggucaagggguacaccaagggcggcccggggcacgaggagcccauccccauggccacguacggcuggaaccuggugaagcugcacuccgggaaggacguguucuucaugcccccggagaagugcgacacccuccugugcgacaucggcgagagcucccccaaccccaccaucgaggaggggcgcacccugcggguccucaagaugguggagcccuggcugcgcggcaaccaguucugcaucaagauccugaacccguacaugcccagcguggucgagacgcucgagcagaugcagcggaagcacggcgggaugcuggugcgcaacccccugucccggaacagcacccacgagauguacuggguguccugcggcaccgggaacaucgucagcgccgugaacaugaccucccgcaugcuccugaaccgguucacgauggcccaccgcaagcccaccuacgagcgcgacguggaccugggcgcgggcacccggcacgucgccguggagccggagguggccaaccucgacaucaucgggcagcgcaucgagaacaucaagaacgagcacaagagcaccuggcacuacgacgaggacaaccccuacaagacgugggccuaccacggcuccuacgaggucaagcccagcggguccgccagcuccauggugaacggcgugguccggcugcugaccaagcccugggacgugaucccgauggucacccagaucgcgaugaccgacacgacccccuucgggcagcagcgcguguucaaggagaagguggacacccggacgccccgggccaagcggggcacgacccagaucauggaggucaccgccaaguggcucuggggcuuccugagccgcaacaagaagccgcggaucugcacccgcgaggaguucacgcggaaggugcgcuccaacgccgccaucggggcgguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgccgacgacaccgcggggugggacacccggaucacggaggacgaccuccagaacgaggccaagaucaccgaguucauggagcccgagcacgcccugcuggccaccuccaucuucaagcucaccuaccagaacaaggugguccgcgugcagcgccccgccaagaacggcacggugauggacgucaucagccggcgcgaccagcggggguccggccaggugggcaccuacgggcugaacaccuucaccaacauggaggugcagcugauccgccagauggagagcgagggcaucuuccucccguccgagcuggagacgcccaaccuggcggagcgggucuucgacuggcucgagaagcacggggccgagcgccugaagcggauggccaucagcggcgacgacugcguggugaagcccaucgacgaccgcuucgccaccgcccugaccgcgcucaacgacauggggaagguccggaaggacaucccccagugggagccguccaagggcuggaacgacuggcagcagguccccuucugcagccaccacuuccaccagcugaucaugaaggacggccgcgagaucgugguccccugccggaaccaggacgagcugguggggcgcgcccgggugucccagggcgccggguggagccuccgcgagaccgccugccugggcaaguccuacgcccagauguggcagcugauguacuuccaccggcgcgaccuccggcuggcggccaacgccaucugcagcgccguccccguggacugggugccgaccucccgcacgaccuggagcauccacgcgcaccaccaguggaugaccaccgaggacaugcugagcgucuggaaccggguguggaucgaggagaaccccuggauggaggacaagacgcacguguccagcugggaggagguccccuaccucgggaagcgcgaggaccaguggugcggcucccugaucggccugaccgcccgcgccaccugggccaccaacauccagguggccaucaaccaggugcggcgccucaucgggaacgagaacuaccuggacuacaugacgagcaugaagcgguucaagaacgaguccgaccccgagggcgcgcugugguga

SEQ ID NO: 8125 - RNA, 9879 nt, Artificial Sequence
  derived and/or modified CDS sequence (opt1) from DENV-1__KJ189369__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugacgggcacccuggccguguuccugcuccuggugauggggcagcugaccuggaacgaccucauccgccugugcaucauggucggcgccaacgcguccgaccgcauggggaugggcaccacguaccuggcccucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucacggaguuccagccccaccagcuguggaccacccugcucagccugaccuucaucaagacgacccugucccucgacuacgccuggaagaccaccgccauggcccugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaagaacgccgccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcgcggaccuacagcgacccgcucgcccugcgcgaguucaaggaguucgccgccgggcggcgcuccgugagcggcgaccugauccucgagaucggcaagcugccccagcaccugacgcuccgggcccagaacgcgcuggacaaccuggucaugcuccacaacagcgagcagggcgggaaggccuaccgccacgccauggaggagcugcccgacaccaucgagacccugaugcuccuggcccugaucgcggugcucaccgggggcgugacgcuguucuuccuguccgggaagggccucggcaagaccagcaucgggcugcugugcgucaccgccuccagcgcccuccuguggauggccuccguggagccccacuggaucgccgcgagcaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgccgcggagaaccaccagcacgccaccaugcuggacguggaccugcggccggccuccgccuggacgcucuacgccguggcgaccaccgucaucacccccaugaugcgccacacgaucgagaacaccaccgccaacaucagccugaccgccaucgccaaccaggccgcgauccugaugggccucgacaagggcuggcccaucuccaagauggacaucggggugccccugcuggcccucggcugcuacagccaggugaacccgcugacgcugaccgccgccguccucaugcugguggcgcacuacgccaucaucgggcccggccugcaggccaaggccacccgggaggcccagaagcgcaccgcggccgggaucaugaagaaccccacgguggacggcaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggcgaccgggccgcucaccacccugugggagggcucccccgggaaguucuggaacacgaccaucgccgucagcauggccaacaucuuccggggcuccuaccuggccggcgccgggcucgcguucagccugaugaagucccugggcgggggccgccgggggaccggcgcccagggcgagacccucggggagaaguggaagcgccagcugaaccagcugagcaaguccgaguucaacacguacaagcggagcggcaucauggagguggaccgcagcgaggccaaggaggggcucaagcggggcgagaccaccaagcacgccgugucccgcgggaccgcgaagcugcggugguucgucgagcgcaaccuggugaagcccgagggcaaggugaucgaccugggcugcgggcggggcggguggagcuacuacugcgccggccucaagaaggucaccgaggugaagggguacacgaagggcggccccgggcacgaggagccgauccccauggccaccuacggcuggaaccuggugaagcugcacuccgggaaggacgucuucuucaugccgcccgagaagugcgacacccuccugugcgacaucggcgagagcuccccgaaccccaccaucgaggaggggcgcacgcugcgggugcucaagaugguggagcccuggcugcgcggcaaccaguucugcaucaagauccugaaccccuacaugccgagcgucguggagacccucgagcagaugcagcggaagcacggcgggaugcuggugcgcaacccccugucccggaacagcacccacgagauguacugggucuccugcggcaccgggaacaucgugagcgccgugaacaugacgucccgcaugcuccugaaccgguucaccauggcccaccgcaagcccaccuacgagcgcgacgucgaccugggcgcgggcacccggcacguggccguggagcccgaggucgccaaccucgacaucaucgggcagcgcaucgagaacaucaagaacgagcacaagagcacguggcacuacgacgaggacaacccguacaagaccugggccuaccacggcuccuacgaggugaagcccagcggguccgccagcuccauggugaacggcgucgugcggcugcugaccaagcccugggacgucauccccauggugacccagaucgcgaugacggacaccaccccguucgggcagcagcgcguguucaaggagaaggucgacacccggacgccccgcgccaagcggggcaccacccagaucauggaggugaccgccaaguggcucuggggcuuccugagccgcaacaagaagccccggaucugcacgcgcgaggaguucacccggaaggugcgcuccaacgccgccaucggggcggucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgccgacgacaccgcggggugggacacgcggaucaccgaggacgaccuccagaacgaggccaagaucaccgagaucauggagcccgagcacgcccugcuggccaccuccaucuucaagcucacguaccagaacaaggucgugcgcgugcagcgccccgccaagaacggcaccgucauggacgugaucagccggcgcgaccagcggggguccggccaggugggcaccuacgggcugaacaccuucacgaacauggagguccagcugauccgccagauggagagcgagggcaucuuccuccccuccgagcuggagaccccgaaccuggcggagcgggugcucgacuggcuggagaagcacggggccgagcgccugaagcggauggccaucagcggcgacgacugcguggucaagcccaucgacgaccgcuucgccaccgcccucaccgcgcugaacgacauggggaaggugcggaaggacaucccccagugggagcccuccaagggcuggaacgacuggcagcaggucccguucugcagccaccacuuccaccagcugaucaugaaggacggccgcgagaucgucgugcccugccggaaccaggacgagcucguggggcgcgcccgggucucccagggcgccggguggagccugcgcgagaccgccugccugggcaaguccuacgcccagauguggcagcucauguacuuccaccggcgcgaccugcggcuggcggccaacgccaucugcagcgccgugcccguggacuggguccccacgucccgcaccaccuggagcauccacgcgcaccaccaguggaugaccacggaggacaugcucagcguguggaaccggguguggaucgaggagaacccguggauggaggacaagacccacgucuccagcugggaggaggugcccuaccuggggaagcgcgaggaccaguggugcggcucccugaucggccucaccgcccgcgccaccugggccacgaacauccagguggccaucaaccagguccggcgccugaucgggaacgagaacuaccuggacuacaugaccagcaugaagcgguucaagaacgaguccgaccccgagggcgcgcucugguga

SEQ ID NO: 8126 - RNA, 9879 nt, Artificial Sequence
  derived and/or modified CDS sequence (opt1) from DENV-1__EU482615__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggacuacaugaccuccaugaagcgguucaagagcgaguccgaccccgagggcgcccucugguga

SEQ ID NO: 8127 - RNA, 9879 nt, Artificial Sequence
  derived and/or modified CDS sequence (opt1) from DENV-1__EU482616__SS-prME
agcgugaccaugcugcucaugcugcugcccaccgcccucgccuuccaccugaccacccggggcggggagccccacaugaucgugaacaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcucccagaccggcgagcaccggcgggacaagcgcagcguggcccuggcgccccacgugggccuggggcucgagacgcggaccgagaccuggauguccagcgagggcgccuggaagcagauccagcgggucgagaccugggcccugcggcaccccggguucacggugaucgcccuguuccucgcgcacgccaucggcaccuccaucacccagaaggggaucaucuucauccugcugaugcucgugacccccagcauggccaugcgcugcgucggcaucggcaaccgggacuucguggaggggcuguccggcgccacguggguggacgucgugcuggagcacgggagcugcgugaccaccauggccaagaacaagcccacccucgacaucgagcugcugaagacggaggucaccaaccccgcgauccuccgcaagcugugcaucgaggccaagaucuccaacaccaccacggacagccggugcccgacccagggcgaggccacccugguggaggagcaggacgccaacuucgugugccgccggaccuucgucgaccgcggcugggggaacggcugcggccucuucggcaaggggucccugcugacgugcgccaaguucaagugcgugaccaagcucgagggcaagaucgugcaguacgagaaccugaaguacagcgucaucgugaccgugcacaccggcgaccagcaccaggucgggaacgagacgaccgagcacggcaccaucgcgaccaucacgccccaggcccccacguccgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccagcggggccuccaccagccaggagaccuggaaccgccaggaccuccuggugacguucaagaccgcccacgcgaagaagcaggagguggucgugcugggcagccaggagggcgccaugcacaccgcccucaccggggccacggagauccagaccuccggcaccaccacgaucuucgccgggcaccugaagugccggcugaagauggacaagcucacccugaagggcaccagcuacgugaugugcaccggguccuucaagcuggagaaggaggucgcggagacgcagcacggcaccgugcuggugcaggucaaguacgagggcaccgacgcccccugcaagauccccuucagcacccaggacgagaagggggugacgcagaacggccgccucaucaccgccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccacggcccgcggggcccgccggauggccauccucggcgacaccgcgugggacuucggguccaucggcggcgucuucaccagcguggggaagcuggugcaccaggucuucggcaccgccuacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgcgagcugaagugcgggagcggcaucuucgugaccaacgagguccacaccuggaccgagcaguacaaguuccaggccgacuccccgaagcggcugagcgcggccaucggcaaggccugggaggagggggugugcggcauccgcagcgccacccggcucgagaacaucauguggaagcagaucuccaacgagcugaaccacauccugcucgagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacgaccagcgggccuggaacaucugggagguggaggacuacggcuucgggaucuucacgaccaacaucuggcugaagcuccgcgacagcuacacccagaugugcgaccaccggcugauguccgcggccaucaaggacagcaaggccguccacgccgacaugggcuacuggaucgaguccgagaagaacgagaccuggaagcuggcccgcgcgagcuucaucgaggugaagacgugcaccuggcccaagucccacacccucuggagcaacggcgugcuggaguccgagaugaucauccccaagaucuacgggggcccgaucagccagcacaacuaccggcccggguacuucacccagacggccggccccuggcaccuggggaagcucgagcuggacuucgaccugugcgagggcaccaccgucgugguggacgagcacugcggcaaccgcgggccgucccuccggaccacgaccgucaccggcaagaucauccacgaguggugcugccgcagcugcacccugccgccccugcgguuccgcggggaggacggcugcugguacgggauggagauccggcccgugaaggagaaggaggagaaccucgugcgcuccauggucagcgccggcuccggcgagguggacagcuucagccuggggauccugugcgccuccaucaugaucgaggaggugaugcggagccgcuggucccggaagaugcucaugacgggcacccuggccgucuuccugcuccugaucauggggcagcugaccuggaacgaccucauccgccugugcaucauggugggcgcgaacgccagcgaccgcauggggaugggcaccacguaccuggcccucauggccaccuucaagaugcggccgauguucgccguggggcugcuguuccgccggcucaccucccgcgagguccugcugcucaccaucgggcugagccugguggcguccguggagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgccuggaagaccaccgccauggcgcuguccaucgucagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccaucggcaucgucuccauccugcucagcucccugcugaagaacgacgugccccucgccgggccgcugaucgccggcggcaugcugaucgccugcuacgugaucagcgggagcuccgcggaccucagccuggagaaggccgccgaggucuccugggagcaggaggccgagcacagcggcaccucccacaacauccugguggaggugcaggacgacgggaccaugaagaucaaggacgaggagaaggacgacacccucacgauccugcugaaggccacccuccuggcggucagcggcguguaccccauguccauccccgccacccuguucgugugguacuucuggcagaagaagaagcagcgcagcgggguccucugggacacccccuccccgcccgagguggagcgggccgugcuggacgacggcaucuaccgcauccugcagcggggccugcucgggcgcagccaggucggcguggggguguuccaggacggcgucuuccacacgauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgcggucgagcccgggaagaacccgaagaacgugcagaccacgcccggcaccuucaagacccccgagggcgaggugggggccaucgcccuggacuucaagcccggcaccuccgggagcccgaucgucaaccgcgagggcaagaucgugggccuguacgggaacggcguggucacgaccuccgggaccuacgugagcgccaucgcccaggcgaaggccucccaggagggcccccuccccgagaucgaggacgagguguucaagaagcggaaccugaccaucauggaccugcacccggggagcggcaagacgcgccgguaccuccccgccaucguccgcgaggccaucaagcggaagcugcgcacccugauccucgcgcccacccgggugguggccagcgagauggccgaggcccugaagggcaugcccauccgcuaccagaccacggccgucaaguccgagcacaccgggcgcgagaucguggaccugaugugccacgcgaccuucaccaugcggcuccugagcccggugcgcguccccaacuacaacaugaucaucauggacgaggcccacuucacggaccccgccuccaucgccgcccggggcuacaucagcacccgcguggggaugggcgaggcggccgccaucuucaugaccgccacgccgcccggguccguggaggccuucccccagagcaacgcggucauccaggacgaggagcgggacauccccgagcgcuccuggaacagcggcuacgacuggaucacggacuuccccggcaagaccgugugguucgugcccuccaucaagagcgggaacgacaucgccaacugccugcggaagaacggcaagcgcgucauccagcucucccggaagaccuucgacaccgaguaccagaagacgaagaacaacgacugggacuacguggugaccaccgacaucagcgagaugggggccaacuuccgcgccgaccgggucaucgacccccgccggugccugaagcccgugauccugaaggacggccccgagcgcgugauccucgcggggccgaugcccgucaccguggccuccgccgcccagcggcgcggccggaucggccgcaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgggagaaguccgccgccaucgacggcgaguaccgccugcgcggggaggcccggaagaccuucgucgagcucaugcgccggggcgaccugcccguguggcuguccuacaaggucgcgagcgagggcuuccaguacuccgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccgcucgcccugcgggaguucaaggaguucgccgccgggcgccgguccgucagcggcgaccugauccucgagaucggcaagcugccccagcaccugacgcuccgcgcgcagaacgcccuggacaaccuggugaugcuccacaacagcgagcagggcgggaaggccuaccggcacgccauggaggagcugcccgacaccaucgagacccugaugcuccuggcgcugaucgccgugcucaccgggggcgucacgcuguucuuccuguccgggaagggccucggcaagaccagcaucgggcugcugugcgugaccgccuccagcgcccuccuguggauggccuccguggagccccacuggaucgcggccagcaucauccuggaguucuuccucaugguccugcugaucccggagcccgaccgccagcggacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcgcccggccuccgccuggacgcucuacgcggucgccaccaccgugaucacccccaugaugcggcacacgaucgagaacaccaccgccaacaucagccugaccgccaucgccaaccaggcggccauccugaugggccucgacaagggcuggcccaucuccaagauggacaucggggugccccugcuggcccucggcugcuacagccaggucaacccgcugacgcugaccgccgcggugcucaugcugguggcccacuacgccaucaucgggcccggccugcaggccaaggccacccgcgaggcgcagaagcggaccgccgccgggaucaugaagaaccccacggucgacggcaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccgggccgcucaccacccugugggagggcucccccgggaaguucuggaacacgaccaucgccgugagcauggccaacaucuuccgcggcuccuaccuggccggcgcggggcucgccuucagccugaugaagucccugggcgggggccggcgcgggaccggcgcccagggcgagacccucggggagaaguggaagcggcagcugaaccagcugagcaaguccgaguucaacacguacaagcgcagcggcaucauggagguggaccggagcgaggccaaggaggggcucaagcgcggcgagaccaccaagcacgcggucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacacgaagggcggccccgggcacgaggagccgauccccauggccaccuacggcuggaaccuggucaagcugcacuccgggaaggacguguucuucaugccgcccgagaagugcgacacccuccugugcgacaucggcgagagcuccccgaaccccaccaucgaggaggggcggacgcugcgcgugcucaagauggucgagcccuggcugcggggcaaccaguucugcaucaagauccugaaccccuacaugccgagcgugguggagacccucgagcagaugcagcgcaagcacggcgggaugcugguccggaacccccugucccgcaacagcacccacgagauguacuggguguccugcggcaccgggaacaucgugagcgccgucaacaugacgucccggaugcuccugaaccgcuucaccauggcgcaccggaagcccaccuacgagcgcgacguggaccugggcgccggcacccgccacguggccgucgagcccgagguggccaaccucgacaucaucgggcagcggaucgagaacaucaagaacgagcacaagagcacguggcacuacgacgaggacaacccguacaagaccugggccuaccacggcuccuacgaggugaagcccagcggguccgcgagcuccauggucaacggcguggugcgccugcugaccaagcccugggacgucauccccauggugacccagaucgccaugacggacaccaccccguucgggcagcagcgggucuucaaggagaagguggacacccgcacgccccgggccaagcgcggcaccacccagaucauggaggugaccgccaaguggcucuggggcuuccugagccggaacaagaagccccgcaucugcacgcgggaggaguucacccgcaagguccgguccaacgccgcgaucggggccguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagaucccgggcggcaacauguacgcggacgacaccgccgggugggacacgcgcaucaccgaggacgaccuccagaacgaggccaagaucaccgacaucauggagcccgagcacgcccugcuggccaccuccaucuucaagcucacguaccagaacaagguggugcggguccagcgccccgcgaagaacggcaccgugauggacgugaucagccgccgggaccagcgcggguccggccaggucggcaccuacgggcugaacaccuucacgaacauggaggugcagcugauccggcagauggagagcgagggcaucuuccuccccuccgagcuggagaccccgaaccuggccaagcgcgugcucgacuggcuggagaagcacggggccgagcggcugaagcgcauggccaucagcggcgacgacugcgucgugaagcccaucgacgaccgguucgccaccgcgcucaccgcccugaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcucgucgggcgggcccgcgugucccagggcgccggguggagccugcgggagaccgccugccugggcaaguccuacgcgcagauguggcagcucauguacuuccaccgccgggaccugcgccuggccgccaacgccaucugcagcgcggugcccgucgacugggugcccacgucccggaccaccuggagcauccacgcccaccaccaguggaugaccacggaggacaugcucagcguguggaaccgcgucuggaucgaggagaacccguggauggaggacaagacccacguguccagcugggaggaggugcccuaccuggggaagcgggaggaccaguggugcggcucccugaucggccucaccgcccgcgccaccugggccacgaacauccaggucgcgaucaaccaggugcgccggcugaucgggaacgagaacuaccuggacuacaugaccagcaugaagcgcuucaagaacgaguccgaccccgagggcgcccucugguga

SEQ ID NO: 8128 - RNA, 9879 nt, Artificial Sequence
  derived and/or modified CDS sequence (opt1) from DENV-1__EU482618__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggacuacaugaccuccaugaagcgguucaagaacgagagcgaccccgagggcgcccucugguga

SEQ ID NO: 8129 - RNA, 9879 nt, Artificial Sequence
  derived and/or modified CDS sequence (opt1) from DENV-1__EU482619__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucaucgacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacgcgggucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugcggcgcauggccaucuccggcgacgacugcgucgugaagcccaucgacgaccgguucgccaccgcgcucaccgcccugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcgcagauguggcagcucauguacuuccaccgccgggaccugcgccuggccgccaacgccaucugcuccgcggugcccgucgacugggugcccacgagccggaccaccuggagcauccacgcccaccaccaguggaugaccacggaggacaugcucuccguguggaaccgcgucuggaucgaggagaacccguggauggaggacaagacccacgugagcuccugggaggaggugcccuaccuggggaagcgcgaggaccaguggugcggcagccugaucggccucaccgcccgggccaccugggccacgaacauccaggucgcgaucaaccaggugcgccggcugaucgggaacgagaacuaccuggacuacaugaccuccaugaagcgcuucaagaacgagagcgaccccgagggcgcccucugguga

SEQ ID NO: 8130 - RNA, 9879 nt, Artificial Sequence
  derived and/or modified CDS sequence (opt1) from DENV-1__FJ898433__SS-prME
agcgugaccaugcugcucaugcugcugcccaccgcccucgccuuccaccugacgacccggggcggggagccccacaugaucgugagcaagcaggagcggggcaagagccuccucuucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggagaagcgcuccguggcccuggcgccccacgugggccuggggcucgagacgcggaccgagaccuggaugagcuccgagggcgccuggaagcagauccagcgggucgagaccugggcccugcggcaccccggguucacggugaccgcccuguuccucgcgcacgccaucggcaccagcaucacccagaaggggaucaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaagaacaagcccacgcucgacaucgagcugcugaagaccgaggucaccaaccccgcgauccuccgcaagcugugcaucgaggccaagaucagcaacaccacgaccgacucccggugccccacccagggcgaggccacccugguggaggagcaggacgccaacuucgugugccgccggacguucgucgaccgcggcugggggaacggcugcggccucuucggcaaggggagccugcugaccugcgccaaguucaagugcgugaccaagcucgagggcaagaucgugcaguacgagaaccugaaguacuccgucaucgugaccgugcacacgggcgaccagcaccaggucgggaacgagaccaccgagcacggcaccaucgcgaccaucacgccccaggcccccaccagcgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccuccggggccagcaccagccaggagacguggaaccgccaggaccuccuggugaccuucaagaccgcccacgcgaagaagcaggagguggucgugcugggcucccaggagggcgccaugcacaccgcccucacgggggccaccgagauccagaccagcggcaccacgaccaucuucgccgggcaccugaagugccggcugaagauggacaagcucacccugaagggcaccuccuacgugaugugcacggggagcuucaagcuggagaaggaggucgcggagacccagcacggcaccgugcuggugcaggucaaguacgagggcaccgacgcccccugcaagauccccuucuccacgcaggacgagaagggggugacccagaacggccgccucaucaccgccaacccgaucgugaccgacaaggagaagcccgucaacaucgagacggagccgcccuucggggagagcuacaucguggugggcgccggcgagaaggcgcugaagcuguccugguucaagaaggggagcuccaucggcaagauguucgaggccaccgcccgcggggcgcgccggauggccauccucggcgacaccgcgugggacuucgggagcaucggcggcgucuucaccuccguggggaagcuggugcaccaggucuucggcacggccuacggggugcuguucagcggcguguccuggaccaugaagaucgggaucggcauccuccugaccuggcugggccucaacagccgcuccaccagccuguccaugacgugcaucgccgucgggauggugacccuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacgcggcucgagaacaucauguggaagcagaucagcaacgagcugaaccacauccugcucgagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacaaccagcgggccuggaacaucugggagguggaggacuacggcuucgggaucuucaccaccaacaucuggcugaagcuccgcgacuccuacacccagaugugcgaccaccggcugaugagcgcggccaucaaggacuccaaggccguccacgccgacaugggcuacuggaucgagagcgagaagaacgagacguggaagcuggcccgcgcguccuucaucgaggugaagaccugcaccuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgacagcugcgagggcaccaccgucgugguggacgagcacugcggcaaccgcgggccgucccugcggacgaccaccgucaccggcaagaucauccacgaguggugcugccgcagcugcacgcugccgccccugcgguuccgcggggaggacggcugcugguacgggauggagauccggcccgugaaggagaaggaggagaaccuggugcgcuccauggucagcgccggcagcggcgagguggacuccuucagccucgggauccugugcguguccaucaugaucgaggaggucaugcggagccgcuggucccggaagaugcugaugaccggcacccucgccguguuccugcugcucaucauggggcagcugaccuggaaggaccugauccgccucugcaucauggugggcgccaacgcgagcgaccgcauggggaugggcacgaccuaccuggcccugauggccaccuucaagaugcggccgauguucgccgucggccuccuguuccgccggcugaccucccgcgaggugcuccugcugacgaucgggcucagccugguggccuccgucgagcugcccaacagccucgaggagcugggcgacgggcuggcgaugggcaucaugaugcucaagcugcugaccgaguuccacccccaccagcucuggaccacccugcugucccucacguucaucaagaccacccugagccuggacuacgccuggaagaccacggccauggcccucuccaucgugagccuguucccccugugccucuccaccaccagccagaagaccaccuggcugccgguccugcucggcuccuucgggugcaagccccugacgauguuccugaucaccgagaacaagaucuggggccgcaagagcuggccccucaacgaggggaucauggcgaucggcaucguguccauccugcugagcagccuccugaagaacgacgugccccuggccgggccgcucaucgccggcggcaugcugaucgccugcuacgucaucuccgggagcuccgccgaccugagccucgagaaggcggccgagguguccugggagcaggaggccgagcacagcggcaccucccacaacauccugguggagguccaggacgacgggaccaugaagaucaaggacgaggagcgcgacgacacgcugaccauccuccugaaggccacccugcucgccgugagcggcguguaccccauguccauccccgcgacccuguucgucugguacuucuggcagaagaagaagcagcggagcggggugcugugggacacgcccuccccgcccgagguggagcgcgccguccucgacgacggcaucuaccggauccugcagcgcggccugcuggggcggagccaggugggcgugggggucuuccaggacggcguguuccacaccauguggcacgugacccgcggggccguccucauguaccagggcaagcggcuggagcccuccugggccagcgugaagaaggaccugaucuccuacggcgggggcuggcgcuuccaggggagcuggaacaccggcgaggaggugcaggucaucgccguggagcccgggaagaacccgaagaacgugcagacgacccccggcaccuucaagacccccgagggcgaggucggggcgaucgcccucgacuucaagcccggcacguccgggagcccgaucgugaaccgggagggcaagaucgugggccuguacgggaacggcgucgugaccaccuccgggaccuacgugagcgccaucgcccaggccaaggcgagccaggagggcccccugcccgagaucgaggacgaggucuucaagaagcgcaaccucacgaucauggaccugcacccgggguccggcaagacccggcgcuaccugcccgccaucgugcgggaggccaucaagcgcaagcuccggacccugauccuggcccccacccgcguggucgcgagcgagauggccgaggcccucaagggcaugcccauccgcuaccagacgaccgccgugaaguccgagcacaccgggcgggagaucguggaccugaugugccacgccaccuucacgaugcgccugcucagcccgguccgggugcccaacuacaacaugaucaucauggacgaggcgcacuucaccgaccccgccuccaucgccgcccgcggcuacaucagcacccggguggggaugggcgaggccgcggccaucuucaugaccgccacgcccccgggguccgucgaggccuucccccagagcaacgccgugauccaggacgaggagcgcgacauccccgagcgguccuggaacagcggcuacgacuggaucaccgacuuccccggcaagaccgugugguucgucccguccaucaagagcgggaacgacaucgcgaacugccugcgcaagaacggcaagcgggugauccagcugucccgcaagaccuucgacacggaguaccagaagaccaagaacaacgacugggacuacguggucaccaccgacaucagcgagaugggggccaacuuccgggccgaccgcgugaucgacccccggcgcugccucaagcccgugauccugaaggacggccccgagcgggucauccuggccgggccgaugcccgugacgguggcguccgccgcccagcgccggggccgcaucggccggaaccagaacaaggagggggaccaguacgucuacaugggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccgccugcgcggggaggcccgcaagaccuucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcgcggacguacagcgacccgcuggcccuccgcgaguucaaggaguucgccgccgggcggcgcagcguguccggcgaccugauccuggagaucggcaagcucccccagcaccugacccugcgggcccagaacgcgcucgacaaccuggugaugcugcacaacagcgagcagggcgggaaggccuaccgccacgccauggaggagcuccccgacaccaucgagacccugaugcugcucgcccugaucgcgguccugaccggcggggugacccucuucuuccuguccgggaaggggcugggcaagaccagcaucgggcuccugugcgugaccgccuccagcgcccugcucuggauggccuccgucgagccccacuggaucgccgcgagcaucauccuggaguucuuccugauggugcuccugaucccggagcccgaccggcagcgcacgccccaggacaaccagcuggccuacguggucaucggccuccuguucaugauccugaccguggccgccaacgagauggggcuccuggagaccaccaagaaggaccugggcaucgggcacguggccgcggagaaccaccagcacgccacgaugcucgacgucgaccugcggccggccuccgccuggacccuguacgccguggcgaccaccgugaucacgcccaugaugcgccacaccaucgagaacaccaccgccaacaucagccucacggccaucgccaaccaggccgcgauccugaugggccuggacaagggcuggcccaucuccaagauggacaucggggucccccuccuggcccugggcugcuacagccaggugaacccgcucacccugaccgccgccgugcugaugcucgucgcgcacuacgccaucaucgggcccggccugcaggccaaggccacccgggaggcccagaagcgcacggcggccgggaucaugaagaaccccaccguggacggcaucguggccaucgaccuggaccccgucguguacgacgccaaguucgagaagcagcucggccagaucaugcugcugauccucugcaccucccagauccugcugaugcgcaccacgugggcccucugcgagagcaucacccuggcgaccgggccgcugaccacgcucugggagggcucccccgggaaguucuggaacaccaccaucgccgugagcauggccaacaucuuccggggcuccuaccuggccggcgccgggcuggcguucagccucaugaagucccugggcgggggccgccgggggaccggcgcccagggcgagacgcugggggagaaguggaagcgccagcucaaccagcugagcaagagcgaguucaacaccuacaagcgguccggcaucauggaggucgaccgcagcgaggccaaggaggggcugaagcggggcgagaccaccaagcacgccgugucccgcgggaccgcgaagcuccggugguucguggagcgcaaccuggucaagcccgagggcaaggugaucgaccugggcugcgggcggggcggguggagcuacuacugcgccggccugaagaaggugacggaggucaagggguacaccaagggcggccccgggcacgaggagccgauccccauggccaccuacggcuggaaccucgugaagcugcacuccgggaaggacguguucuucaugccgcccgagaagugcgacacccugcucugcgacaucggcgagagcuccccgaaccccacgaucgaggaggggcgcacccugcggguccugaagaugguggagcccuggcuccgcggcaaccaguucugcaucaagauccugaaccccuacaugccgagcguggucgagacccuggagcagaugcagcggaagcacggcgggaugcucgugcgcaacccccugucccggaacagcacccacgagauguacuggguguccugcggcacggggaacaucgucagcgccgugaacaugaccucccgcaugcugcucaaccgguucaccauggcccaccgcaagcccaccuacgagaaggacguggaccugggcgcgggcacgcgccacgucgccguggagcccgagguggccaaccuggacaucaucgggcagcggaucgagaacaucaagaacgagcacaagagcaccuggcacuacgacgaggacaacccguacaagaccugggccuaccacggcuccuacgaggucaagcccagcggguccgccagcuccauggugaacggcgugguccgccuccugaccaagcccugggacgugauccccauggucacgcagaucgcgaugaccgacaccaccccguucgggcagcagcggguguucaaggagaagguggacacgcgcacgccccgggccaagcgcggcaccacccagaucauggaggucacggccaaguggcuguggggcuuccucagccggaacaagaagccccgcaucugcacccgggaggaguucacccgcaaggugcggagcaacgccgccaucggggcgguguucgucgacgagaaccaguggaacuccgccaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggcgaagggcagccgcgccaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagaucccgggcggcaacauguacgccgacgacacggcggggugggacacccgcaucaccgaggacgaccugcagaacgaggccaagaucaccgacaucauggagcccgagcacgcccuccuggccacguccaucuucaagcugaccuaccagaacaaggugguccgggugcagcgccccgccaagaacggcaccgugauggacgucaucagccgccgggaccagcgcggguccggccaggugggcaccuacgggcucaacacguucaccaacauggaggugcagcugauccggcagauggagagcgagggcaucuuccugcccuccgagcucgagaccccgaaccuggcggagcgcguccuggacuggcucgggaagcacggcgccgagcggcugaagcgcauggccaucagcggggacgacugcguggugaagcccaucgacgaccgguucgccaccgcccugaccgcgcucaacgacaugggcaagguccgcaaggacaucccccagugggagcccuccaagggcuggaacgacuggcagcaggucccguucugcagccaccacuuccaccagcugaucaugaaggacgggcgggagaucgugguccccugccgcaaccaggacgagcuggugggccgggcccgcgugucccagggggccggcuggagccucaaggagacggccugccuggggaaguccuacgcccagauguggcagcugauguacuuccaccggcgcgaccuccggcuggcggccaacgccaucugcagcgccguccccguggacugggugcccaccagccgcaccaccugguccauccacgcgcaccaccaguggaugacgaccgaggacaugcugagcgucuggaaccggguguggaucgaggagaacccguggauggaggacaagacccacguguccagcugggaggagguccccuaccucggcaagcgcgaggaccaguggugcggcucccugaucgggcugaccgcccgggccacgugggccaccaacauccagguggccaucaaccaggugcgccgccucaucggcaacgagaacuaccuggacuacaugaccagcaugaagcgguucaagaacgaguccgaccccgagggggcgcugugguga

SEQ ID NO: 8131 - RNA, 9879 nt, Artificial Sequence
  derived and/or modified CDS sequence (opt1) from DENV-1__FJ547088__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggggagcucugcgaggacaccaugaccuacaagugcccccagaucaccgaggccgagcccgacgacguggacugcuggugcaacgccaccgacaccugggucaccuacgggaccugcagccagaccggggagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgugggccugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaaguacggcgggaugcugguccgcaacccccugagccggaacuccacccacgagauguacugggugagcugcggcaccgggaacaucguguccgccgucaacaugacgagccgcaugcuccugaaccgguucaccauggcccaccgcaagcccaccuacgagcgcgacguggaccugggcgcgggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggucaacggcguggugcggcugcugaccaagcccugggacgucauccccauggugacccagaucgcgaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgccaucggggcgguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgccaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggcggggcgggugcucgacuggcuggagaagcacggcgccgagcgccugaagcggauggccaucuccggggacgacugcgucgugaagcccaucgacgaccgcuucgccaccgcccucaccgcgcugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcccagauguggcagcucauguacuuccaccggcgcgaccugcggcuggcggccaacgccaucugcuccgccgugcccgucgacugggugcccacgagccgcaccaccuggagcauccacgcgcaccaccaguggaugaccacggaggacaugcucuccguguggaaccgggucuggaucgaggagaacccguggauggaggacaagacccacgugagcuccugggaggaggugcccuaccugggcaagcgcgaggaccaguggugcggcagccugaucgggcucaccgcccgcgccaccugggccacgaacauccaggucgccaucaaccaggugcggcgccugaucggcaacgagaacuaccuggacuacaugaccuccaugaagcgguucaagaacgagagcgaccccgagggggcgcucugguga

SEQ ID NO: 8132 - RNA, 9879 nt, Artificial Sequence
  derived and/or modified CDS sequence (opt1) from DENV-1__FJ810419__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccccugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagaccagcgagggcgaggugggggccaucgcccuggacuucaagcccggcaccuccgggagccccaucgucaaccgggagggcaagaucgugggccuguacgggaacggcguggucacgaccuccgggaccuacgugagcgccaucgcccaggcgaaggccagccaggagggcccgcuccccgagaucgaggacgagguguucaagaagcgcaaccugaccaucauggaccugcaccccggguccggcaagacgcggcgcuaccucccggccaucguccgggaggccaucaagcgcaagcugcggacccugauccucgcgcccacccgcgugguggccagcgagauggccgaggcccugaagggcaugcccauccgcuaccagaccacggccgucaaguccgagcacaccgggcgggagaucguggaccugaugugccacgcgaccuucaccaugcgccuccugagccccgugcgggucccgaacuacaacaugaucaucauggacgaggcccacuucacggaccccgccuccaucgccgcccgcggcuacaucagcacccggguggggaugggcgaggcggccgccaucuucaugaccgccacgccgcccggguccguggaggccuucccgcagagcaacgcggucauccaggacgaggagcgcgacauccccgagcgguccuggaacagcggcuacgacuggaucacggacuuccccggcaagaccgugugguucgugcccuccaucaagagcgggaacgacaucgccaacugccugcgcaagaacggcaagcgggucauccagcucucccgcaagaccuucgacaccgaguaccagaagacgaagaacaacgacugggacuacguggugaccaccgacaucagcgagaugggggccaacuuccgggccgaccgcgucaucgacccgcggcgcugccugaagcccgugauccugaaggacggccccgagcgggugauccucgcggggcccaugccggucaccguggccuccgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucauccccgcccuguucgagccggagcgcgagaaguccgccgccaucgacggcgaguaccgccugcgcggggaggcccgcaagaccuucgucgagcucaugcggcgcggcgaccugcccguguggcuguccuacaaggucgcgagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcccugcgcgaguucaaggaguucgccgccgggcggcgcagcgucuccggcgaccugauccucgagaucggcaagcugccgcagcaccugacgcuccgggcgcagaacgcccuggacaaccuggugaugcuccacaacagcgagcagggcgggaaggccuaccgccacgccauggaggagcugcccgacaccaucgagacccugaugcuccuggcgcugaucgccgugcucaccgggggcgucacgcuguucuuccuguccgggaagggccucggcaagaccagcaucgggcugcugugcgugaccgccuccagcgcccuccuguggauggccuccguggagccccacuggaucgcggccagcaucauccuggaguucuuccucaugguccugcugauccccgagccggaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggcccgccuccgccuggacgcucuacgcggucgccaccaccgugaucaccccgaugaugcgccacacgaucgagaacaccaccgccaacaucagccugaccgccaucgccaaccaggcggccauccugaugggccucgacaagggcuggcccaucuccaagauggacaucggggugccccugcuggcccucggcugcuacagccaggucaacccccugacgcugaccgccgcggugcucaugcugguggcccacuacgccaucaucgggccgggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccucccagauccugcucaugcgcaccaccugggcgcugugcgagagcaucacgcuggccaccgggccccucaccacccugugggagggcuccccggggaaguucuggaacacgaccaucgccgugagcauggccaacaucuuccggggcuccuaccuggccggcgcggggcucgccuucagccugaugaagucccugggcgggggccgccgggggaccggcgcccagggcgagacccucggggagaaguggaagcgccagcugaaccagcugagcaagagcgaguucaacacguacaagcgguccggcaucauggagguggaccgcagcgaggccaaggaggggcucaagcggggcgagaccaccaagcacgcggucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcuguacuccgggaaggacguguucuucaugccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgccgucaacaugacgucccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaagagcacguggcacuacgacgaggacaaccccuacaagaccugggccuaccacggcuccuacgaggugaagccgagcggguccgcgagcuccauggucaacggcguggugcggcugcugaccaagcccugggacgucauccccauggugacccagaucgccaugacggacaccacccccuucgggcagcagcgcgucuucaaggagaagguggacacccggacgccgcgcgccaagcggggcaccacccagaucauggaggugaccgccaaguggcucuggggcuuccugagccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgcggacgacaccgccgggugggacacgcggaucaccgaggacgaccuccagaacgaggccaagaucaccgacaucauggagccggagcacgcccugcuggccaccuccaucuucaagcucacguaccagaacaagguggugcgcguccagcgccccgcgaagaacggcaccgugauggacgugaucagccggcgcgaccagcggggguccggccaggucggcaccuacgggcugaacaccuucacgaacauggaggugcagcugauccgccagauggagagcgagggcaucuuccuccccuccgagcuggagacccccaaccuggccgagcgggugcucgacuggcuggagaagcacggggccgagcgccugaagcggauggccaucagcggcgacgacugcgucgugaagccgaucgacgaccgcuucgccaccgcgcucaccgcccugaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcucgucgggcgcgcccgggugucccagggcgccggguggagccugcgcgagaccgccugccugggcaaguccuacgcgcagauguggcagcucauguacuuccaccggcgcgaccugcggcuggccgccaacgccaucugcagcgcggugcccgucgacugggugcccacgagccgcaccaccugguccauccacgcccaccaccaguggaugaccacggaggacaugcucagcguguggaaccgggucuggaucgaggagaaccccuggauggaggacaagacccacguguccagcugggaggaggugccguaccuggggaagcgcgaggaccaguggugcggcucccugaucggccucaccgcccgcgccaccugggccacgaacauccaggucgcgaucaaccaggugcggcgccugaucgggaacgagaacuaccuggacuacaugaccagcaugaagcgguucaagaacgaguccgaccccgagggcgcccucugguga

SEQ ID NO: 8133 - RNA, 9879 nt, Artificial Sequence
  derived and/or modified CDS sequence (opt1) from DENV-1__FJ547068__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccuggcggccagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgcgauggcccugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgcgugcuacgugaucagcggguccagcgccgaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggcgacccuccuggccguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggcguccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcgcaggccaaggccagccaggagggcccccuccccgagaucgaggacgagguguucaagaagcgcaaccugaccaucauggaccugcacccggggagcggcaagacgcggcgcuaccuccccgccaucgugcgggaggcgaucaagcgcaagcugcggacccugauccucgcccccacccgcgucguggccuccgagauggccgaggcccugaagggcaugcccauccgcuaccagaccacggcggucaagagcgagcacaccgggcgggagaucgucgaccugaugugccacgccaccuucaccaugcgccuccuguccccggugcgggugcccaacuacaacaugaucaucauggacgaggcccacuucacggaccccgccagcaucgccgcgcgcggcuacaucuccacccgggucgggaugggcgaggccgccgccaucuucaugaccgccacgccgcccgggagcguggaggcguucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggcggaccgcgugaucgacccccggcgcugccugaagcccgucauccugaaggacggccccgagcgggugauccucgccgggccgaugcccgugaccgucgccagcgccgcccagcgccggggccgcaucggccggaaccagaacaaggagggggaccaguacguguacaugggccagccccugaacaacgacgaggaccacgcgcacuggacggaggccaagaugcugcucgacaacaucaacacccccgaggggaucaucccggcccuguucgagcccgagcgcgagaaguccgccgccaucgacggcgaguaccgccugcgcggggaggcgcgcaagaccuucguggagcucaugcggcgcggcgaccugcccgucuggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgcggggcggcgcagcgugagcggcgaccugauccucgagaucggcaagcugccccagcaccugacgcuccgggcccagaacgcccuggacaaccuggucaugcuccacaacuccgagcagggcgggaaggccuaccgccacgcgauggaggagcugcccgacaccaucgagacccugaugcuccuggcccugaucgccgugcucaccgggggcgugacgcuguucuuccugagcgggaagggccucggcaagaccuccaucgggcugcugugcgucaccgccagcuccgcccuccuguggauggcgagcguggagccccacuggaucgccgccuccaucauccuggaguucuuccucauggugcugcugaucccggagcccgaccggcagcgcacgccccaggacaaccagcucgccuacgucgugaucggccugcuguucaugauccucacgguggccgcgaacgagauggggcugcuggagaccaccaagaaggaccucggcaucgggcacgucgccgccgagaaccaccagcacgccaccaugcuggacguggaccugcggccggccagcgcguggacgcucuacgccguggccaccaccgucaucacccccaugaugcgccacacgaucgagaacaccaccgccaacaucucccugaccgccaucgcgaaccaggccgccauccugaugggccucgacaagggcuggcccaucagcaagauggacaucggggugccccugcuggcccucggcugcuacucccaggugaacccgcugacgcugaccgcggccguccucaugcugguggcccacuacgccaucaucgggcccggccugcaggccaaggcgacccgggaggcccagaagcgcaccgccgccgggaucaugaagaaccccacgguggacggcaucgucgccaucgaccucgaccccgugguguacgacgcgaaguucgagaagcagcugggccagaucaugcugcucauccugugcaccagccagauccugcucaugcgcaccaccugggcccugugcgaguccaucacgcuggccaccgggccgcucaccacccugugggagggcagccccgggaaguucuggaacacgaccaucgccgucuccauggccaacaucuuccggggcagcuaccuggcgggcgccgggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggcgaaggaggggcucaagcggggcgagaccaccaagcacgccgugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgcggugaacaugacgagccgcaugcuccugaaccgguucaccauggcccaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggcguaccacggcagcuacgaggugaagcccuccgggagcgccuccagcauggugaacggcgucgugcggcugcugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgcggccaucggggccgucuucguggacgagaaccaguggaacagcgccaaggaggcgguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcgcugggguucaugaacgaggaccacugguucagccgggagaacucccugagcggcguggagggggagggccuccacaagcugggguacauccugcgcgacaucuccaagaucccgggcggcaacauguacgccgacgacaccgccgggugggacacgcggaucaccgaggacgaccuccagaacgaggccaagaucaccgacaucauggagcccgagcacgcccugcuggcgaccagcaucuucaagcucacguaccagaacaaggucgugcgcgugcagcgccccgccaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgcgaccgcccucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgcgugccugggcaagagcuacgcccagauguggcagcucauguacuuccaccggcgcgaccugcggcuggccgccaacgcgaucugcuccgccgugcccguggacuggguccccacgagccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggcgacgaacauccagguggccaucaaccagguccggcgccugaucgggaacgagaacuaccuggacuacaugaccuccaugaagcgguucaagaacgagagcgaccccgagggcgcccucugguga

SEQ ID NO: 8134 - RNA, 9879 nt, Artificial Sequence
  derived and/or modified CDS sequence (opt1) from DENV-1__FJ562104__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaaguacggcgggaugcugguccgcaacccccugagccggaacuccacccacgagauguacugggugagcugcggcaccgggaacaucguguccgccgucaacaugacgagccgcaugcuccugaaccgguucaccauggcccaccgcaagcccaccuacgagcgcgacguggaccugggcgcgggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggucaacggcguggugcggcugcugaccaagcccugggacgucauccccauggugacccagaucgcgaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgccaucggggcgguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgccaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggcggagcgggugcucgacuggcuggagaagcacggggccgagcgccugaagcggauggccaucuccggcgacgacugcgucgugaagcccaucgacgaccgcuucgccaccgcccucaccgcgcugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcccagauguggcagcucauguacuuccaccggcgcgaccugcggcuggcggccaacgccaucugcuccgccgugcccgucgacugggugcccacgagccgcaccaccuggagcauccacgcgcaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgccaucaaccaggugcggcgccugaucgggaacgagaacuaccuggacuacaugaccuccaugaagcgguucaagaacgagagcgaccccgagggcgcgcucugguga

SEQ ID NO: 8135 - RNA, 9879 nt, Artificial Sequence
  derived and/or modified CDS sequence (opt1) from DENV-1__GQ199857__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucaucucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccgucuccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaaguacggcgggaugcuggugcgcaacccccugagccggaacuccacccacgagauguacugggucagcugcggcaccgggaacaucguguccgccgugaacaugacgagccgcaugcuccugaaccgguucaccauggcccaccgcaagcccaccuacgagcgcgacgucgaccugggcgcgggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggugaacggcgucgugcggcugcugaccaagcccugggacgugauccccauggucacccagaucgcgaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgccaucggggcggucuucaucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaaggugguccgcgugcagcgccccgccaagaacggcaccgugauggacgucaucucccggcgcgaccagcgggggagcggccaggugggcaccuacgggcugaacaccuucacgaacauggaggugcagcugauccgccagauggaguccgagggcaucuuccuccccagcgagcuggagaccccgaaccuggcggagcggguccucgacuggcuggagaagcacggggccgagcgccugaagcggauggccaucuccggcgacgacugcguggugaagcccaucgacgaccgcuucgccaccgcccucaccgcgcugaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcucguggggcgcgcccgggugagccagggcgccggguggucccugcgcgagaccgccugccugggcaagagcuacgcccagauguggcagcucauguacuuccaccggcgcgaccugcggcuggcggccaacgccaucugcuccgccguccccguggacugggugcccacgagccgcaccaccuggagcauccacgcgcaccaccaguggaugaccacggaggacaugcucuccgucuggaaccggguguggaucgaggagaacccguggauggaggacaagacccacgugagcuccugggaggagguccccuaccuggggaagcgcgaggaccaguggugcggcagccugaucggccucaccgcccgcgccaccugggccacgaacauccagguggccaucaaccaggugcggcgccugaucgggaacgagaacuaccuggacuacaugaccuccaugaagcgguucaagaacgagagcgaccccgagggcgcgcucugguga

SEQ ID NO: 8136 - RNA, 9879 nt, Artificial Sequence
  derived and/or modified CDS sequence (opt1) from DENV-1__GQ199858__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucaucucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccgucuccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccuggggcacgaggagcccaucccgauggccaccuacggcuggaaccuggugaagcuccacagcgggaaggacgucuucuucaugccgcccgagaagugcgacacccugcugugcgacaucggcgaguccagccccaacccgaccaucgaggaggggcgcacgcuccgggugcugaagaugguggagcccuggcugcgcggcaaccaguucugcaucaagauccucaaccccuacaugcccuccgucguggagacccuggagcagaugcagcggaaguacggcgggaugcuggugcgcaacccgcucagccggaacuccacccacgagauguacugggucagcugcggcaccgggaacaucguguccgccgugaacaugacgagccgcaugcugcugaaccgguucaccauggcccaccgcaagcccaccuacgagcgcgacgucgaccucggcgcgggcacccggcacguggccguggagcccgaggucgccaaccuggacaucaucgggcagcgcaucgagaacaucaagaacgagcacaaguccacguggcacuacgacgaggacaaccccuacaagaccugggccuaccacggcagcuacgaggugaagccguccgggagcgccuccagcauggugaacggcgucgugcggcugcucaccaagcccugggacgugauccccauggucacccagaucgcgaugacggacaccacccccuucgggcagcagcgcguguucaaggagaaggucgacacccggacgccgcgcgccaagcggggcaccacccagaucauggaggugaccgccaaguggcuguggggcuuccugucccgcaacaagaagccccggaucugcacgcgcgaggaguucacccggaaggugcgcagcaacgccgccaucggggcggucuucguggacgagaaccaguggaacagcgccaaggaggccguggaggacgagcgguucugggaccucguccaccgcgagcgggagcugcacaagcagggcaagugcgcgaccugcguguacaacaugauggggaagcgcgagaagaagcugggcgaguucgggaaggcgaagggcucccgggccaucugguacauguggcucggcgcccgcuuccuggaguucgaggcccugggguucaugaacgaggaccacugguucagccgggagaacucccucagcggcguggagggggagggccugcacaagcugggguacauccuccgcgacaucuccaagauccccggcggcaacauguacgccgacgacaccgcggggugggacacgcggaucaccgaggacgaccugcagaacgaggccaagaucaccgacaucauggagccggagcacgcccugcucgccaccagcaucuucaagcugacguaccagaacaaggucgugcgcgugcagcgccccgccaagaacggcaccgucauggacgugaucucccggcgcgaccagcgggggagcggccaggugggcaccuacgggcugaacaccuucacgaacauggagguccagcucauccgccagauggaguccgagggcaucuuccugcccagcgagcuggagacccccaaccucgcggagcgggugcuggacuggcuggagaagcacggggccgagcgccucaagcggauggccaucuccggcgacgacugcguggucaagccgaucgacgaccgcuucgccaccgcccugaccgcgcugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggucccugcgcgagaccgccugccucggcaagagcuacgcccagauguggcagcugauguacuuccaccggcgcgaccugcggcucgcggccaacgccaucugcuccgccgugcccguggacuggguccccacgagccgcaccaccuggagcauccacgcgcaccaccaguggaugaccacggaggacaugcuguccguguggaaccggguguggaucgaggagaaccccuggauggaggacaagacccacgucagcuccugggaggaggugccguaccuggggaagcgcgaggaccaguggugcggcagccucaucggccugaccgcccgcgccaccugggccacgaacauccagguggccaucaaccagguccggcgccugaucgggaacgagaacuaccucgacuacaugaccuccaugaagcgguucaagaacgagagcgaccccgagggcgcgcugugguga

SEQ ID NO: 8137 - RNA, 9879 nt, Artificial Sequence
  derived and/or modified CDS sequence (opt1) from DENV-1__GQ199859__SS-prME
agcgugaccaugcuccucaugcugcugcccaccgcccucgccuuccaccugacgacccgcggcggggagccccacaugaucgugagcaagcacgagcggggcaagagccuccuguucaagaccagcaccggggugaacaugugcacgcugaucgccauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcggguggagacgugggcccugcgccacccgggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccugacccuggacugcagcccccggacgggccucgacuucaacgagaugguccugcugaccaugaaggagaaguccuggcucgugcacaagcagugguuccuggaccugccgcuccccuggaccuccggggccagcaccagccaggagacguggaaccggcaggaccugcuggugaccuucaagaccgcccacgccaagaagcaggaggucguggugcucggcucccaggagggcgcgaugcacaccgcccugacgggggccaccgagauccagaccagcggcaccacgaccaucuucgccgggcaccugaagugccgccucaagauggacaagcugacccugaagggcaccuccuacgucaugugcacggggagcuucaagcuggagaaggagguggccgagacccagcacggcaccgugcucguccaggugaaguacgagggcaccgacgcgcccugcaagauccccuucuccacgcaggacgagaagggggugacccagaacggccggcugaucaccgccaacccgaucgucaccgacaaggagaagcccgugaacaucgagacggagccgcccuucggggagagcuacaucguggucggcgccggcgagaaggcccugaagcucuccugguucaagaaggggagcuccaucggcaagauguucgaggcgaccgcccgcggggcccggcgcauggccauccugggcgacaccgccugggacuucgggagcaucggcggcguguucaccuccguggggaagcugguccaccagguguucggcacggcguacgggguccucuucagcggcgucuccuggaccaugaagaucgggaucggcauccugcugaccuggcucggccugaacagccgcuccaccagccuguccaugacgugcaucgccguggggauggugacccucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgccgcgaucggcaaggccugggaggagggggugugcggcauccgguccgccacgcgccuggagaacaucauguggaagcagaucagcaacgagcugaaccacauccuccuggagaacgacaugaaguucaccgucguggugggggacgccaacggcauccuggcccaggggaagaagaugauccggccccagcccauggagcacaaguacuccuggaaguccuggggcaaggcgaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcucaagcugcgggacuccuacacccagaugugcgaccaccgccugaugagcgccgcgaucaaggacuccaaggccgugcacgccgacaugggcuacuggaucgagagcgagaagaacgagacguggaagcucgcccgggccuccuucaucgaggugaagaccugcaccuggcccaagagccacacccugugguccaacggcguccuggagagcgagaugaucauccccaagaucuacgggggcccgaucucccagcacaacuaccgccccggguacuucacgcagaccgcgggccccuggcaccucgggaagcuggagcuggacuucgaccucugcgagggcaccaccgugguggucgacgagcacugcggcaaccgggggccgagccugcgcacgaccaccgugaccggcaagaucauccacgaguggugcugccgguccugcacgcugccgccccuccgcuuccgcggggaggacggcugcugguacgggauggagauccgccccgugaaggagaaggaggagaaccugguccggagcaugguguccgccggcagcggcgagguggacagcuucucccuggggauccucugcgucagcaucaugaucgaggaggugaugcgcucccgguggagccgcaagaugcugaugaccggcacccuggccguguuccuccugcugaucauggggcagcucaccuggaacgaccugauccgccugugcaucauggucggcgccaacgccuccgaccggauggggaugggcacgaccuaccucgcgcugauggccaccuucaagaugcgcccgauguucgccgugggcauccuguuccggcgccucaccagccgggaggugcugcugcucacgaucgggcugucccuggucgccagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgcguggaagaccacggccauggcccugagcaucgucucccuguucccccucugccugagcaccaccucccagaagaccaccuggcugccggugcuccugggcagcuucgggugcaagccccugacgauguaccucaucaccgagaacaagaucuggggccgcaaguccuggcccaucaacgaggggaucauggccaucggcaucgugagcauccugcuguccagccuccugaagaacgacgucccccuggcggggccgcucaucgccggcggcaugcugaucgccugcuacgugaucagcggguccagcgccgaccugucccucgagaaggccgcggaggugagcugggagcaggaggccgagcacuccggcaccagccacaacauccuggucgaggugcaggacgacgggaccaugcggaucaaggacgaggagaaggacgacacgcugaccauccuccugaaggccacccugcucgccguguccggcgucuaccccaugagcauccccgccacccuguucgugugguacuucuggcagaagaagaagcagcgcuccggggugcugugggacacgcccagcccgcccgaggucgagcgggcggugcucgacgacggcaucuaccgcauccugcagcggggccugcuggggcgcucccaggugggcgucgggguguuccaggacggcguguuccacaccauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagacgacccccggcaccuucaagacccccgagggcgaggugggggccaucgcgcucgacuucaagcccggcacgagcggguccccgaucgugaaccgcgagggcaagaucgucggccuguacgggaacggcguggugaccaccagcgggaccuacgucuccgccaucgcccaggccaaggccagccaggagggcccccugcccgagaucgaggacgagguguucaagaagcggaaccucacgaucauggaccugcacccggggagcggcaagacccgccgguaccugcccgcgaucgugcgcgaggccaucaagcggaagcuccgcacccugauccuggcccccacccgcgucguggccuccgagauggcggaggcccucaagggcaugcccauccgguaccagacgaccgccgucaagagcgagcacaccgggcgcgagaucgucgaccugaugugccacgccaccuucacgaugcggcugcucuccccggugcgcgugcccaacuacaacaugaucaucauggacgaggcccacuucaccgaccccgcgagcaucgccgcccggggcuacaucuccacccgcgucgggaugggcgaggccgccgcgaucuucaugaccgccacgcccccggggagcguggaggccuucccccaguccaacgccgugauccaggacgaggagcgggacauccccgagcgcagcuggaacuccggcuacgacuggaucaccgacuuccccggcaagaccgucugguucgugccgagcaucaaguccgggaacgacaucgccaacugccugcggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccccgccggugccucaagcccgucauccugaaggacggccccgagcgcgugauccuggccgggccgaugcccgugacggucgccagcgcggcccagcggcgcggccggaucggccgcaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcccgcacguacuccgacccgcuggcgcuccgggaguucaaggaguucgccgccgggcgccggagcgugagcggcgaccugauccuggagaucggcaagcucccccagcaccugacccugcgcgcccagaacgcccucgacaaccuggucaugcugcacaacuccgagcagggcgggaaggcguaccggcacgccauggaggagcuccccgacaccaucgagacccugaugcugcucgcccugaucgccgugcugaccgggggcgugacccucuucuuccugagcgggaagggccugggcaagaccuccaucgggcuccugugcgucaccgcgagcuccgcccugcucuggauggccagcguggagccccacuggaucgccgccuccaucauccuggaguucuuccugauggugcuccugaucccggagcccgaccgccagcggacgccccaggacaaccagcuggcguacgucgugaucggccuccuguucaugauccugaccguggccgccaacgagauggggcuccuggagaccaccaagcgcgaccugggcaucgggcacgucgccgccgagaaccaccagcacgcgacgaugcucgacguggaccugcggccggccagcgccuggacccuguacgccguggccaccaccgucaucacgcccaugaugcgccacaccaucgagaacaccaccgcgaacaucucccucacggccaucgccaaccaggccgccauccugaugggccuggacaagggcuggcccaucagcaagauggacaucggggugccccuccuggcgcugggcugcuacucccaggugaacccgcucacccugaccgccgccguccugaugcucguggcccacuacgcgaucaucgggcccggccugcaggccaaggccacccgcgaggcccagaagcggacggccgcggggaucaugaagaaccccaccguggacggcaucgucgccaucgaccuggaccccgugguguacgacgccaaguucgagaagcagcucggccagaucaugcugcugauccucugcaccagccagauccugcugaugcgcaccacgugggcccucugcgaguccaucacccuggccaccgggccgcugaccacgcucugggagggcagccccgggaaguucuggaacaccaccaucgcggucuccauggccaacaucuuccggggcagcuaccuggccggcgccgggcuggccuucucccucaugaagucccugggcgggggccgccgggggaccggcgcgcagggcgagacgcugggggagaaguggaagcgccagcucaaccagcuguccaagcccgaguucaacaccuacaagcggagcggcaucauggagguggaccgcagcgaggccaaggaggggcugaagcggggcgagaccaccaagcacgccgugucccgcgggaccgccaagcuccggugguucgucgagcgcaaccuggugaagcccgagggcaaggugaucgaccugggcugcgggcggggcggguggagcuacuacugcgcgggccugaagaaggucacggaggugaagggguacaccaagggcggcccggggcacgaggagcccauccccauggccaccuacggcuggaaccucgugaagcugcacuccgggaaggacgucuucuucaugcccccggagaagugcgacacccugcucugcgacaucggcgagagcucccccaaccccacgaucgaggaggggcgcacccugcgggugcugaagaugguggagcccuggcuccgcggcaaccaguucugcaucaagauccugaacccguacaugcccagcgucguggagacccuggagcagaugcagcggaagcacggcgggaugcucgugcgcaacccccugucccggaacagcacccacgagauguacugggucuccugcggcacggggaacaucgugagcgccgugaacaugaccucccgcaugcugcucaaccgcuucaccauggcccaccggaagcccaccuacgagcgcgacgucgaccugggcgccggcacgcggcacguggcgguggagccggaggucgccaaccuggacaucaucgggcagcgcaucgagaacaucaagaacgagcacaagagcaccuggcacuacgacgaggacaaccccuacaagaccugggccuaccacggcuccuacgaggugaagcccagcggguccgccagcuccauggugaacggcgucgugcggcuccugaccaagcccugggacgucaucccgauggugacgcagaucgccaugaccgacaccacccccuucgggcagcagcgcguguucaaggagaaggucgacacgcggacgccccgggcgaagcggggcaccacccagaucauggaggugacggccaaguggcuguggggcuuccucagccgcaacaagaagccgcggaucugcacccgcgaggaguucacccggaaggugcgcuccaacgccgccaucggggccgucuucguggacgagaaccaguggaacagcgcgaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggcgaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgccgacgacacggccgggugggacacccgcaucaccgaggacgaccugcagaacgaggcgaagaucaccgacaucauggagcccgagcacgcccuccuggccacguccaucuucaagcugaccuaccagaacaaggucgugcgggugcagcgccccgccaagaacggcaccgucauggacgugaucagccggcgcgaccagcggggguccggccaggugggcaccuacgggcucaacacguucaccaacauggagguccagcugauccgccagauggagagcgagggcaucuuccugccguccgagcucgagacccccaaccuggccgagcgggugcuggacuggcucgagaagcacggggcggagcgccugaagcggauggccaucagcggcgacgacugcguggucaagcccaucgacgaccgcuucgccaccgcccugaccgcccucaacgacauggggaaggugcggaaggacaucccccagugggagccguccaagggcuggaacgacuggcagcagguccccuucugcagccaccacuuccaccagcugaucaugaaggacggccgcgagaucgucgugcccugccggaaccaggacgagcugguggggcgcgcgcgggucucccagggcgccggguggagccuccgcgagacggccugccugggcaaguccuacgcccagauguggcagcugauguacuuccaccggcgcgaccuccggcuggccgcgaacgccaucugcagcgccgugcccguggacugggucccgaccucccgcaccaccuggagcauccacgcccaccaccaguggaugacgaccgaggacaugcugagcguguggaaccgcguguggaucgaggagaaccccuggauggaggacaagacccacgucuccagcugggaggaggugcccuaccucgggaagcgggaggaccaguggugcggcucccugaucggccugaccgcgcgcgccacgugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8138 - RNA, 9879 nt, Artificial Sequence
  derived and/or modified CDS sequence (opt1) from DENV-1__JF937645__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggacccucgucgaccgcggcugggggaacggcugcgggcuguucggcaaggggagccugcucacgugcgccaaguucaagugcgugaccaagcuggagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcucaccgacuacggggcccugacccuggacugcagcccccggaccggccucgacuucaacgagauggugcugcugacgaugaaggagaaguccuggcucguccacaagcagugguuccuggaccugccgcuccccuggaccuccggggccagcaccagccaggagaccuggaaccgccaggaccugcuggugacguucaagaccgcccacgcgaagaagcaggagguggucgugcucggcucccaggagggcgccaugcacaccgcccugaccggggccacggagauccagaccagcggcaccaccacgaucuucgccgggcaccugaagugccggcucaagauggacaagcugacccugaagggcaccuccuacgugaugugcaccgggagcuucaagcuggagaaggaggucgcggagacgcagcacggcaccgugcucgugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccgcccuucggggagagcuacaucguggugggcgccggcgagaaggcgcugaagcucuccugguucaagaaggggagcuccaucggcaagauguucgaggccacggcccgcggggcccgccggauggccauccugggcgacaccgcgugggacuucgggagcaucggcggcgucuucaccuccguggggaagcuggugcaccaggucuucggcaccgccuacgggguccuguucagcggcguguccuggacgaugaagaucgggaucggcauccugcugaccuggcucggccugaacagccgcuccaccagccuguccaugaccugcaucgccgucgggauggugacgcucuaccugggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcucagcgcggccaucggcaaggccugggaggagggggugugcggcauccgcuccgccacccggcuggagaacaucauguggaagcagaucagcaacgagcugaaccacauccuccuggagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcucaagcugcgcgacuccuacacccagaugugcgaccaccggcugaugagcgcggccaucaaggacuccaaggccguccacgccgacaugggcuacuggaucgagagcgagaagaacgagaccuggaagcucgcccgcgcguccuucaucgaggugaagacgugcaccuggcccaagagccacacccugugguccaacggcgugcuggagagcgagaugaucauccccaagaucuacgggggcccgaucucccagcacaacuaccggcccggguacuucacccagacggccggccccuggcaccucgggaagcuggagcuggacuucgaccucugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccuggggauccucugcgccagcaucaugaucgaggaggugaugcggucccgcuggagccggaagaugcugaugacgggcacccuggccgucuuccuccugcugaucauggggcagcucaccuggaacgaccugauccgccugugcaucauggugggcgcgaacgccuccgaccgcauggggaugggcaccacguaccucgcccugauggccaccuucaagaugcggccgauguucgccgugggccuccucuuccgccggcugaccagccgcgagguccugcuccugaccaucgggcugucccucguggcgagcguggagcugcccaacucccuggaggagcucggcgacgggcuggccaugggcaucaugaugcugaagcuccugacggaguuccagccccaccagcuguggaccacccuccugagccugaccuucaucaagacgacccucucccuggacuacgccuggaagaccaccgccauggcgcugagcaucgucucccucuucccccugugccugagcacgaccucccagaagaccaccuggcucccggugcugcugggcagcuucgggugcaagccccucaccauguuccugaucacggagaacaagaucuggggccggaaguccuggccccugaacgaggggaucauggccaucggcaucgucagcauccuccuguccagccugcucaagaacgacgugccccuggccgggccgcugaucgccggcggcaugcucaucgccugcuacgugaucagcggguccagcgcggaccugucccuggagaaggccgccgaggucagcugggagcaggaggccgagcacuccggcaccagccacaacauccucguggaggugcaggacgacgggaccaugaagaucaaggacgaggagcgcgacgacacccugacgauccugcucaaggccacccugcuggcggucuccggcguguaccccaugagcauccccgccacccucuucgugugguacuucuggcagaagaagaagcagcgguccgggguccugugggacacccccagcccgcccgagguggagcgcgccgugcuggacgacggcaucuaccggauccugcagcgcggccuccuggggcggucccaggucggcguggggguguuccaggacggcgucuuccacacgauguggcacgugacccgcggggccgugcugauguaccagggcaagcggcucgagcccagcugggccuccgucaagaaggaccugaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccucuacgggaacggcguggucacgaccagcgggaccuacguguccgccaucgcccaggcgaaggccagccaggagggcccccugcccgagaucgaggacgagguguucaagaagcgcaaccugaccaucauggaccuccacccggggagcggcaagacgcggcgcuaccugcccgccaucguccgggaggccaucaagcgcaagcugcggacccucauccuggcgcccacccgcgugguggccuccgagauggccgaggcccugaagggcaugcccauccgcuaccagaccacggccgucaagagcgagcacaccgggcgggagaucguggaccucaugugccacgcgaccuucaccaugcgccugcuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccuccgcaagaacggcaagcgggucauccagcugagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccucaaggacggccccgagcgggugauccuggcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcuccuggacaacaucaacacccccgaggggaucaucccggcccuguucgagcccgagcgcgagaaguccgccgccaucgacggcgaguaccgccuccgcggggaggcccgcaagaccuucgucgagcugaugcggcgcggcgaccugcccguguggcucagcuacaaggucgcguccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcccggaccuacuccgacccgcuggcccugcgcgaguucaaggaguucgccgccgggcggcgcagcgucagcggcgaccucauccuggagaucggcaagcugccccagcaccucacgcugcgggcgcagaacgcccuggacaaccucgugaugcugcacaacuccgagcagggcgggaaggccuaccgccacgccauggaggagcugcccgacaccaucgagacccucaugcugcuggcgcucaucgccgugcugaccgggggcgucacgcuguucuuccucagcgggaagggccugggcaagaccuccaucgggcugcucugcgugaccgccagcuccgcccugcuguggauggccagcguggagccccacuggaucgcggccuccaucauccucgaguucuuccugaugguccugcucaucccggagcccgaccggcagcgcacgccccaggacaaccagcuggccuacguggugaucggccuccucuucaugauccugacggucgccgccaacgagauggggcugcucgagaccaccaagaaggaccugggcaucgggcacguggcggccgagaaccaccagcacgccaccaugcuggacguggaccuccggccggccagcgccuggacgcuguacgcggucgccaccaccgugaucacccccaugaugcgccacacgaucgagaacaccaccgccaacaucucccugaccgccaucgccaaccaggcggccauccucaugggccuggacaagggcuggcccaucagcaagauggacaucggggugccccugcucgcccugggcugcuacucccaggucaacccgcugacgcucaccgccgcggugcugaugcugguggcccacuacgccaucaucgggcccggccuccaggccaaggccacccgggaggcgcagaagcgcaccgccgccgggaucaugaagaaccccacggucgacggcaucguggccaucgaccuggaccccguggucuacgacgccaaguucgagaagcagcugggccagaucaugcuccugauccugugcaccagccagauccuccugaugcgcaccaccugggcgcugugcgaguccaucacgcucgccaccgggccgcugaccacccugugggagggcagccccgggaaguucuggaacacgaccaucgccguguccauggccaacaucuuccggggcagcuaccucgccggcgcggggcuggccuucucccugaugaagucccucggcgggggccgccgggggaccggcgcccagggcgagacccugggggagaaguggaagcgccagcugaaccagcucuccaagagcgaguucaacacguacaagcggagcggcaucauggagguggaccgcuccgaggccaaggaggggcugaagcggggcgagaccaccaagcacgcggucagccgcgggaccgccaagcugcggugguucguggagcgcaaccuggugaagcccgagggcaaggucaucgaccucggcugcgggcggggcgggugguccuacuacugcgccggccugaagaaggugaccgaggugaagggguacacgaagggcggccccgggcacgaggagccgauccccauggccaccuacggcuggaaccuggucaagcuccacagcgggaaggacguguucuucaugccgcccgagaagugcgacacccugcugugcgacaucggcgaguccagcccgaaccccaccaucgaggaggggcgcacgcuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacccacgagauguacugggugagcugcggcaccgggaacaucguguccgccgucaacaugacgagccgcaugcugcugaaccgguucaccauggcgcaccgcaagcccaccuacgagcgcgacguggaccucggcgccggcacccggcacguggccgucgagcccgagguggccaaccuggacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcucaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcuguggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgcggacgacaccgccgggugggacacgcggaucaccgaggacgaccugcagaacgaggccaagaucaccgacaucauggagcccgagcacgcccugcucgccaccagcaucuucaagcugacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcucauccgccagauggaguccgagggcaucuuccugcccagcgagcuggagaccccgaaccucgccgagcgggugcuggacuggcuggagaagcacggggccgagcgccucaagcggauggccaucuccggcgacgacugcgucgugaagcccaucgacgaccgcuucgccaccgcgcugaccgcccugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagaccgccugccucggcaagagcuacgcgcagauguggcagcugauguacuuccaccggcgcgaccugcggcucgccgccaacgccaucugcuccgcggugcccgucgacugggugcccacgagccgcaccaccuggagcauccacgcccaccaccaguggaugaccacggaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgcgccaccugggccacgaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 8139 - RNA, 9879 nt, Artificial Sequence
  derived and/or modified CDS sequence (opt1) from DENV-1__FJ850114__SS-prME
agcgugaccaugcugcucaugcugcugcccaccgcccucgccuuccaccugacgacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccagccccgcgauccuccgcaagcugugcaucgaggccaagaucuccaacaccaccacggacagccggugccccacccagggcgaggccacccugguggaggagcaggacgccaacuucgugugccgccggaccuucgucgaccgcggcugggggaacggcugcggccucuucggcaaggggucccugcugacgugcgccaaguucaagugcgugaccaagcucgagggcaagaucgugcaguacgagaaccugaaguacagcgucaucgugaccgugcacaccggcgaccagcaccaggucgggaacgagacgaccgagcacggcaccaucgcgaccaucacgccccaggcccccacguccgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccagcggggccagcaccucccaggagaccuggaaccgccaggaccuccuggugacguucaagaccgcccacgcgaagaagcaggagguggucgugcugggcagccaggagggcgccaugcacaccgcccucaccggggccacggagauccagaccuccggcaccaccacgaucuucgccgggcaccugaagugccggcugaagauggacaagcucacccugaagggcaccagcuacgugaugugcaccggguccuucaagcuggagaaggaggucgcggagacgcagcacggcaccgugcuggugcaggucaaguacgagggcaccgacgcccccugcaagauccccuucagcacccaggacgagaagggggugacgcagaacggccgccucaucaccgccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccacggcccgcggggcccgccggauggccauccucggcgacaccgcgugggacuucggguccaucggcggcgucuucaccagcguggggaagcuggugcaccaggucuucggcaccgccuacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgcgagcugaagugcgggagcggcaucuucgugaccaacgagguccacaccuggaccgagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacagcuacacccagaugugcgaccaccggcugauguccgcggccaucaaggacagcaaggccguccacgccgacaugggcuacuggaucgaguccgagaagaacgagaccuggaagcuggcccgcgcgagcuucaucgaggugaagacgugcaccuggcccaagucccacacccucuggagcaacggcgugcuggaguccgagaugaucauccccaagaccuacgggggcccgaucagccagcacaacuaccggcccggguacuucacgcagaccgccggccccuggcaccuggggaagcucgagcuggacuucgaccugugcgagggcaccaccgucgugguggacgagcacugcggcaaccgcgggccgucccuccggacgaccaccgucaccggcaagaucauccacgaguggugcugccgcagcugcacgcugccgccccugcgguuccgcggggaggacggcugcugguacgggauggagauccggcccgugaaggagaaggaggagaaccucgugcgcuccauggucagcgccggcagcggcgagguggacuccuucagccuggggauccugugcgccuccaucaugaucgaggaggugaugcggagccgcuggucccggaagaugcucaugaccggcacccuggccgucuuccugcuccugaucauggggcagcugaccuggaacgaccucauccgccugugcaucauggugggcgcgaacgccagcgaccgcauggggaugggcacgaccuaccuggcccucauggccaccuucaagaugcggccgauguucgccgugggccugcuguuccgccggcucaccucccgcgagguccugcugcucacgaucgggcugagccugguggcguccguggagcuccccaacagccuggaggagcugggcgacgggcucgccaugggcaucaugaugcugaagcugcucaccgaguuccagccccaccagcuguggaccacccugcucucccugacguucaucaagaccacccugagccucgacuacgccuggaagaccacggccauggcgcuguccaucgucagccuguucccccucugccuguccaccaccagccagaagaccaccuggcugccggugcuccugggcuccuucgggugcaagccccugacgauguuccucaucaccgagaacaagaucuggggccgcaagagcuggccccugaacgaggggaucauggccaucggcaucgucuccauccugcucagcagccugcugaagaacgacgugccccucgccgggccgcugaucgccggcggcaugcugaucgccugcuacgugaucuccgggagcuccgcggaccucagccuggagaaggccgccgaggucuccugggagcaggaggccgagcacagcggcaccucccacaacauccugguggaggugcaggacgacgggaccaugaagaucaaggacgaggagcgcgacgacacgcucaccauccugcugaaggccacccuccuggcggucagcggcguguaccccauguccauccccgccacccuguucgugugguacuucuggcagaagaagaagcagcggagcgggguccucugggacacgcccuccccgcccgagguggagcgcgccgugcuggacgacggcaucuaccggauccugcagcgcggccugcucgggcggagccaggucggcguggggguguuccaggacggcgucuuccacaccauguggcacgugacccgcggggccgugcugauguaccagggcaagcggcuggagcccuccugggccagcgucaagaaggaccucaucuccuacggcgggggcuggcgcuuccaggggagcuggaacaccggcgaggagguccaggugaucgcggucgagcccgggaagaacccgaagaacgugcagacgacccccggcaccuucaagacccccgagggcgaggugggggccaucgcccuggacuucaagcccggcacguccgggagcccgaucgucaaccgggagggcaagaucgugggccuguacgggaacggcguggucaccaccuccgggaccuacgugagcgccaucgcccaggcgaaggccagccaggagggcccccuccccgagaucgaggacgagguguucaagaagcgcaaccugacgaucauggaccugcacccgggguccggcaagacccggcgcuaccuccccgccaucguccgggaggccaucaagcgcaagcugcggacccugauccucgcgcccacccgcgugguggccagcgagauggccgaggcccugaagggcaugcccauccgcuaccagacgaccgccgucaaguccgagcacaccgggcgggagaucguggaccugaugugccacgcgaccuucacgaugcgccuccugagcccggugcggguccccaacuacaacaugaucaucauggacgaggcccacuucaccgaccccgccuccaucgccgcccgcggcuacaucagcacccggguggggaugggcgaggcggccgccaucuucaugaccgccacgcccccgggguccguggaggccuucccccagagcaacgcggucauccaggacgaggagcgcgacauccccgagcgguccuggaacagcggcuacgacuggaucaccgacuuccccggcaagaccgugugguucgugccguccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggccaacuuccgggccgaccgcgucaucgacccccggcgcugccugaagcccgugauccugaaggacggccccgagcgggugauccucgcggggccgaugcccgucacgguggccuccgccgcccagcgccggggccgcaucggccggaaccagaacaaggagggggaccaguacguguacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcuguccuacaaggucgcgagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggacguacagcgacccgcucgcccugcgcgaguucaaggaguucgccgccgggcggcgcagcgucuccggcgaccugauccucgagaucggcaagcugccccagcaccugacccuccgggcgcagaacgcccuggacaaccuggugaugcuccacaacagcgagcagggcgggaaggccuaccgccacgccauggaggagcugcccgacaccaucgagacccugaugcuccuggcgcugaucgccgugcucaccggcggggucacccuguucuuccuguccgggaaggggcucggcaagaccagcaucgggcugcugugcgugaccgccuccagcgcccuccuguggauggccuccguggagccccacuggaucgcggccagcaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggcggccgagaaccaccagcacgccacgaugcuggacguggaccugcggccggccuccgccuggacccucuacgcggucgccaccaccgugaucacgcccaugaugcgccacaccaucgagaacaccaccgccaacaucagccugacggccaucgccaaccaggcggccauccugaugggccucgacaagggcuggcccaucuccaagauggacaucggggugccccugcuggcccucggcugcuacagccaggucaacccgcugacccugaccgccgcggugcucaugcugguggcccacuacgccaucaucgggcccggccugcaggccaaggccacccgggaggcgcagaagcgcacggccgccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcgcugugcgagagcaucacccuggccaccgggccgcucaccacgcugugggagggcucccccgggaaguucuggaacaccaccaucgccgugagcauggccaacaucuuccggggcuccuaccuggccggcgcggggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggagguggaccgcagcgaggccaaggaggggcucaagcggggcgagaccaccaagcacgcggucucccgcgggaccgccaagcugcggugguucguggagcgcaaccuggugaagcccgagggcaaggucaucgaccugggcugcgggcggggcggguggagcuacuacugcgccggccucaagaaggugacggaggugaagggguacaccaagggcggccccgggcacgaggagccgauccccauggccaccuacggcuggaaccuggucaagcugcacuccgggaaggacguguucuucaugccgcccgagaagugcgacacccuccugugcgacaucggcgagagcuccccgaaccccacgaucgaggaggggcgcacccugcgggugcucaagauggucgagcccuggcugcgcggcaaccaguucugcaucaagauccugaaccccuacaugccgagcgugguggagauccucgagcagaugcagcggaagcacggcgggaugcugguccgcaacccccugucccggaacagcacccacgagauguacuggguguccugcggcaccgggaacaucgugagcgccgucaacaugacgucccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaagagcacguggcacuacgacgaggacaacccguacaagaccugggccuaccacggcuccuacgaggugaagcccagcggguccgcgagcuccauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugagccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagaucccgggcggcaacauguacgcggacgacaccgccgggugggacacgcggaucaccgaggacgaccuccagaacgaggccaagaucaccgacaucauggagcccgagcacgcccugcuggccaccuccaucuucaagcucacguaccagaacaagguggugcgcguccagcgccccgcgaagaacggcaccgugauggacgugaucagccggcgcgaccagcggggguccggccaggucggcaccuacgggcugaacaccuucacgaacauggaggugcagcugauccgccagauggagagcgagggcaucuuccuccccuccgagcuggagaccccgaaccuggccgagcgggugcucgacuggcuggagaagcacggggccgagcgccugaagcggauggccaucagcggcgacgacugcgucgugaagcccaucgacgaccgcuucgccaccgcgcucaccgcccugaacgacauggggaaggugcggaaggacaucccccagugggagcccuccaagggcuggaacgacuggcagcaggucccguucugcagccaccacuuccaccagcugaucaugaaggacggccgcgagaucguggugcccugccggaaccaggacgagcucgucgggcgcgcccgggugucccagggcgccggguggagccugcgcgagaccgccugccugggcaaguccuacgcgcagauguggcagcucauguacuuccaccggcgcgaccugcggcuggccgccaacgccaucugcagcgcggugcccgucgacugggugcccacgagccgcaccaccugguccauccacgcccaccaccaguggaugaccacggaggacaugcucagcguguggaaccgggucuggaucgaggagaacccguggauggaggacaagacccacguguccagcugggaggaggugcccuaccuggggaagcgcgaggaccaguggugcggcucccugaucggccucaccgcccgcgccaccugggccacgaacauccaggucgcgaucaaccaggugcggcgccugaucgggaacgagaacuaccuggacuacaugaucagcaugaagcgguucaagaacgaguccgaccccgagggcgcccucugguga

SEQ ID NO: 8140 - RNA, 9879 nt, Artificial Sequence
  derived and/or modified CDS sequence (opt1) from DENV-1__JN819402__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccaugaccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgguucaccauggcccaccgcaagcccaccuacgagcgcgacguggaccugggcgcgggcacgcggcacguggccgucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcguggugcggcugcugaccaagcccugggacgucauccccauggugacgcagaucgcgaugaccgacaccaccccguucgggcagcagcgcgucuucaaggagaagguggacacgcggacgccccgggccaagcggggcaccacccagaucauggaggugacggccaaguggcucuggggcuuccugucccgcaacaagaagccccggaucugcacccgcgaggaguucacccggaagguccgcagcaacgccgccaucggggcgguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgccgacgacacggcggggugggacacccggaucaccgaggacgaccuccagaacgaggccaagaucaccgacaucauggagcccgagcacgcccugcuggccacgagcaucuucaagcucaccuaccagaacaagguggugcgcguccagcgccccgccaagaacggcaccgugauggacgugaucucccggcgcgaccagcgggggagcggccaggucggcaccuacgggcugaacacguucaccaacauggaggugcagcugauccgccucauggaguccgagggcaucuuccugcccagcgagcuggagaccccgaaccucgcggagcgggugcuggacuggcuggagaagcacggggccgagcgccucaagcggauggccaucuccggcgacgacugcgucgugaagcccaucgacgaccgcuucgccaccgcccugaccgcgcugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagacggccugccucggcaagagcuacgcccagauguggcagcugauguacuuccaccggcgcgaccugcggcucgcggccaacgccaucugcuccgccgugcccgucgacugggugcccaccagccgcaccaccuggagcauccacgcgcaccaccaguggaugacgaccgaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgcgccacgugggccaccaacauccaggucgccaucaaccaggugcggcgccugaucgggaacgagaacuaccucgacuacaugaccuccaugaagcgguucaagagcgaguccgaccccgagggcgcgcugugguga

SEQ ID NO: 8141 - RNA, 9879 nt, Artificial Sequence
  derived and/or modified CDS sequence (opt1) from DENV-1__FJ850113__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccaugguccugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggcgaucggcaucgugagcauccugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcaccagccacaacauccugguggagguccaggacgacgggaccaugaagaucaaggacgaggagcgcgacgacacccucacgauccugcugaaggccacccuccuggccguguccggcguguaccccaugagcauccccgcgacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacacgauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacgcccggcaccuucaagacccccgagggcgaggucggggcgaucgcccuggacuucaagcccggcaccagcggguccccgaucgugaaccgggagggcaagaucgugggccuguacgggaacggcgucgugacgaccagcgggaccuacguguccgccaucgcccaggccaaggcgagccaggagggcccccuccccgagaucgaggacgaggucuucaagaagcgcaaccugaccaucauggaccugcacccggggagcggcaagacgcggcgcuaccuccccgccaucgugcgggaggccaucaagcgcaagcugcggacccugauccucgcccccacccgcguggucgcguccgagauggccgaggcccugaagggcaugcccauccgcuaccagaccacggccgucaagagcgagcacaccgggcgggagaucguggaccugaugugccacgccaccuucaccaugcgccuccuguccccgguccgggugcccaacuacaacaugaucaucauggacgaggcgcacuucacggaccccgccagcaucgccgcccgcggcuacaucuccacccggguggggaugggcgaggccgcggccaucuucaugaccgccacgccgcccgggagcgucgaggccuucccccaguccaacgccgugauccaggacgaggagcgcgacauccccgagcggagcuggaacuccggcuacgacuggaucacggacuuccccggcaagaccgugugguucguccccagcaucaaguccgggaacgacaucgcgaacugccugcgcaagaacggcaagcgggugauccagcucagccgcaagaccuucgacaccgaguaccagaagacgaagaacaacgacugggacuacguggucaccaccgacaucuccgagaugggggccaacuuccgggccgaccgcgugaucgacccccggcgcugccugaagcccgugauccugaaggacggccccgagcgggucauccucgccgggccgaugcccgugaccguggcgagcgccgcccagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcgcggaccuacuccgacccgcucgcccugcgcgaguucaaggaguucgccgccgggcggcgcagcgugagcggcgaccugauccucgagaucggcaagcugccccagcaccugacgcuccgggcccagaacgcgcuggacaaccuggugaugcuccacaacuccgagcagggcgggaaggccuaccgccacgccauggaggagcugcccgacaccaucgagacccugaugcuccuggcccugaucgcgguccucaccgggggcgugacgcuguucuuccugagcgggaagggccucggcaagaccuccaucgggcugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucggccugcuguucaugauccucacgguggccgccaacgagauggggcugcuggagaccaccaagaaggaccucggcaucgggcacguggccgcggagaaccaccagcacgccaccaugcuggacgucgaccugcggccggccagcgccuggacgcucuacgccguggcgaccaccgugaucacccccaugaugcgccacacgaucgagaacaccaccgccaacaucucccugaccgccaucgccaaccaggccgcgauccugaugggccucgacaagggcuggcccaucagcaagauggacaucggggucccccugcuggcccucggcugcuacucccaggugaacccgcugacgcugaccgccgccgugcucaugcuggucgcgcacuacgccaucaucgggcccggccugcaggccaaggccacccgggaggcccagaagcgcaccgcggccgggaucaugaagaaccccacgguggacggcaucguggccaucgaccucgaccccgucguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccguguccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggaggucgaccgcuccgaggccaaggaggggcucaagcggggcgagaccaccaagcacgccgugagccgcgggaccgcgaagcugcggugguucguggagcgcaaccuggucaagcccgagggcaaggugaucgaccugggcugcgggcggggcgggugguccuacuacugcgccggccucaagaaggugaccgaggucaagggguacacgaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccaccaucgaggaggggcgcacgcugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacccacgagauguacugggugagcugcggcaccgggaacaucgucuccgccgugaacaugacgagccgcaugcuccugaaccgguucaccauggcccaccgcaagcccaccuacgagcgcgacguggaccugggcgcgggcacccggcacgucgccguggagcccgagguggccaaccucgacaucaucgggcagcgcaucgagaacaucaagaacgagcacaaguccacguggcacuacgacgaggacaacccguacaagaccugggccuaccacggcagcuacgaggucaagcccuccgggagcgccuccagcauggugaacggcgugguccggcugcugaccaagcccugggacgugauccccauggucacccagaucgcgaugacggacaccaccccguucgggcagcagcgcguguucaaggagaagguggacacccggacgccccgcgccaagcggggcaccacccagaucauggaggucaccgccaaguggcucuggggcuuccugucccgcaacaagaagccccggaucugcacgcgcgaggaguucacccggaaggugcgcagcaacgccgccaucggggcgguguucgucgacgagaaccaguggaacagcgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaaggugguccgcgugcagcgccccgccaagaacggcaccgugauggacgucaucucccggcgcgaccagcgggggagcggccaggugggcaccuacgggcugaacaccuucacgaacauggaggugcagcugauccgccucauggaguccgagggcaucuuccugcccagcgagcuggagaccccgaaccucgcggagcggguccuggacuggcuggagaagcacggggccgagcgccucaagcggauggccaucuccggcgacgacugcguggugaagcccaucgacgaccgcuucgccaccgcccugaccgcgcugaacgacauggggaagguccggaaggacaucccccagugggagcccagcaagggcuggaacgacuggcagcaggucccguucugcucccaccacuuccaccagcucaucaugaaggacggccgcgagaucgugguccccugccggaaccaggacgagcugguggggcgcgcccgggugagccagggcgccggguggucccugcgcgagaccgccugccucggcaagagcuacgcccagauguggcagcugauguacuuccaccggcgcgaccugcggcucgcggccaacgccaucugcuccgccguccccguggacugggugcccacgagccgcaccaccuggagcauccacgcgcaccaccaguggaugaccacggaggacaugcuguccgucuggaaccggguguggaucgaggagaacccguggauggaggacaagacccacgugagcuccugggaggagguccccuaccuggggaagcgcgaggaccaguggugcggcagccucaucggccugaccgcccgcgccaccugggccacgaacauccagguggccaucaaccaggugcggcgccugaucgggaacgagaacuaccucgacuacaugaccuccaugaagcgguucaagagcgaguccgaccccgagggcgcgcugugguga

SEQ ID NO: 8142 - RNA, 9879 nt, Artificial Sequence
  derived and/or modified CDS sequence (opt1) from DENV-1__JF937635__SS-prME
agcgugaccaugcugcucaugcugaugcccaccgcccuggccuuccaccucaccacccggggcggggagccccacaugaucgugagcaagcacgagcggggcaaggcgcugcuguucaagaccagcaccggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccaccccggguucaccgugaucgcccuguuccuggcgcacgccaucggcaccuccaucacccagaaggggaucaucuucauccuccugaugcuggugacgcccagcauggccaugcggugcgucggcaucggcaaccgcgacuucguggaggggcucuccggcgccaccuggguggacgucgugcuggagcacgggagcugcgugaccaccauggccaagaacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccuccugaccugcgccaaguucaagugcgugaccaagcuggagggcaagaucguccaguacgagaaccucaaguacagcgugaucgugaccguccacacgggcgaccagcaccagguggggaacgagaccaccgagcacggcaccaucgcgaccaucacgccccaggcccccaccuccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccuccaccagccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaccagcuacgucaugugcacgggguccuucaagcuggagaaggagguggcggagacccagcacggcaccgugcugguccaggugaaguacgagggcaccgacgcccccugcaagauccccuucagcacgcaggacgagaagggggugacccagaacggccggcugaucaccgccaacccgaucgucaccgacaaggagaagcccgugaacaucgagacggagccgcccuucggggaguccuacaucguggucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagguguucggcacggccuacggggugcuguucuccggcgucagcuggaccaugaagaucgggaucggcauccugcucaccuggcugggccugaacucccgcagcaccucccucagcaugacgugcaucgccguggggauggugacccuguaccugggcgucauggugcaggccgacuccgggugcgugaucaacuggaagggccgggagcucaagugcgggagcggcaucuucgucaccaacgaggugcacaccuggaccgagcaguacaaguuccaggccgacuccccgaagcgccugagcgcggccaucggcaaggccugggaggagggggugugcggcauccggagcgccacgcgccuggagaacaucauguggaagcagaucuccaacgagcucaaccacauccugcuggagaacgacaugaaguucaccgucguggugggggacgccaacggcauccucgcgcaggggaagaagaugauccggccccagcccauggagcacaaguacagcuggaaguccuggggcaaggccaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcugcgggacagcuacacccagaugugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaccuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcugccgccccuccgcuuccgcggggaggacggcugcugguacgggauggagauccgccccgugaaggagaaggaggagaaccugguccgguccauggugagcgccggcuccggcgagguggacagcuucagccucgggauccugugcgucuccaucaugaucgaggaggugaugcgcagccgguggucccgcaagaugcugaugaccggcacccucgccguguuccugcugcucaucauggggcagcugaccuggaacgaccugauccgccucugcaucauggucggcgccaacgcgagcgaccggauggggaugggcacgaccuaccuggcccugauggccaccuucaagaugcgcccgauguucgccgugggcauccucuuccggcgccugaccucccgggaggugcugcuccugacgaucgggcugagccucgucgccuccguggagcugcccaacagccuggaggagcucggcgacgggcuggcgaugggcaucaugaugcugaagcuccugaccgaguuccagccccaccagcuguggaccacccuccugucccugacguucaucaagaccacccucagccuggacuacgccuggaagaccacggccauggcccuguccaucgucagccucuucccccugugccuguccaccaccagccagaagaccaccuggcucccggugcugcugggcuccuucgggugcaagccccucacgauguuccugaucaccgagaacaagaucuggggccgcaagagcuggcccaucaacgaggggaucauggcgaucggcaucguguccauccugcucagcucccugcugaagaacgacgucccccucgccgggccgcugaucgccggcggcaugcugaucgccugcuacgugaucagcgggagcuccgccgaccucagccuggagaaggcggccgagguguccugggagcaggaggccgagcacagcggcaccucccacaacauccuggucgaggugcaggacgacgggaccaugcggaucaaggacgaggagaaggacgacacgcucaccauccugcugaaggccacccuccuggccgugagcggcgucuaccccauguccauccccgcgacccuguucgugugguacuucuggcagaagaagaagcagcgcagcggggugcucugggacacgcccuccccgcccgaggucgagcgggccgugcuggacgacggcaucuaccgcauccugcagcggggccuccuggggcgcagccaggugggcgucgggguguuccaggacggcguguuccacaccauguggcacgucacccgcggggccgugcugauguaccagggcaagcgccuggagcccuccugggccagcgugaagaaggaccucaucuccuacggcgggggcuggcgguuccaggggagcuggaacaccggcgaggagguccaggugaucgccguggagcccgggaagaacccgaagaacguccagacgacccccggcaccuucaagaccuccgagggcgaggugggggcgaucgcccuggacuucaagcccggcacgagcgggucccccaucgugaaccgcgagggcaagaucgucggccuguacgggaacggcguggugaccaccagcgggaccuacgucuccgccaucgcccaggccaagacgagccaggagggcccgccgcccgagaucgaggacgagguguucaagaagcggaaccucaccaucauggaccugcacccggggagcggcaagacccgccgguaccugcccgcgaucgugcgcgaggccaucaagcggaagcuccgcacccugauccuggcccccacgcgcgucguggccuccgagauggcggaggcccucaagggcaugcccauccgguaccagaccaccgccgucaagagcgagcacaccgggcgcgagaucgucgaccugaugugccacgccacguucaccaugcggcugcucuccccggugcgcgugcccaacuacaacaugaucaucauggacgaggcccacuucaccgaccccgcgagcaucgccgcccggggcuacaucuccacccgcgucgggaugggcgaggccgccgcgaucuucaugacggccacgccgcccgggagcguggaggccuucccccaguccaacgccgugauccaggacgaggagcgggacauccccgagcgcagcuggaacuccggcuacgacuggaucaccgacuuccccggcaagaccgucugguucgugcccagcaucaaguccgggaacgacaucgccaacugccugcggaagaacggcaagcgcgugauccagcugagccggaagacguucgacaccgaguaccagaagaccaagaacaacgacugggacuacgucgugaccacggacaucuccgagaugggggcgaacuuccgcgccgaccgggugaucgacccccgccggugccucaagcccgucauccugaaggacggccccgagcgcgugauccuggccgggccgaugcccgugaccgucgccagcgcggcccagcggcgcggccggaucggccgcaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggacgaaggagggcgagcggaagaagcuccgcccccgguggcuggacgcccgcaccuacuccgacccgcuggcgcuccgggaguucaaggaguucgccgccgggcgccggagcgugagcggcgaccugauccuggagaucggcaagcucccccagcaccugacccugcgcgcccagaacgcccucgacaaccuggucaugcugcacaacuccgagcagggcgggaaggcguaccggcacgccauggaggagcuccccgacaccaucgagacgcugaugcugcucgcccugaucgccgugcugaccgggggcgugacccucuucuuccugagcgggaagggccugggcaagaccuccaucgggcuccugugcgucacggcgagcuccgcccugcucuggauggccagcguggagccccacuggaucgccgccuccaucauccuggaguucuuccugauggugcuccugaucccggagcccgaccgccagcggacgccccaggacaaccagcuggcguacgucgugaucggccuccuguucaugauccugaccguggccgccaacgagauggggcuccuggagaccacgaagcgcgaccugggcaucgggcacgucgccgccgagaaccaccagcacgcgaccaugcucgacguggaccugcggccggccagcgccuggacccuguacgccguggccaccacggucaucacccccaugaugcgccacaccaucgagaacaccacggcgaacaucucccucaccgccaucgccaaccaggccgccauccugaugggccuggacaagggcuggcccaucagcaagauggacaucggggugccccuccuggcgcugggcugcuacucccaggugaacccgcucacccugaccgccgccguccugaugcucguggcccacuacgcgaucaucgggcccggccugcaggccaaggccacgcgcgaggcccagaagcggaccgccgcggggaucaugaagaaccccaccguggacggcaucgucgccaucgaccuggaccccgugguguacgacgccaaguucgagaagcagcucggccagaucaugcugcugauccucugcaccagccagauccugcugaugcgcacgaccugggcccucugcgaguccaucacccuggccaccgggccgcugacgacccucugggagggcagccccgggaaguucuggaacaccaccaucgcggucuccauggccaacaucuuccggggcagcuaccuggccggcgccgggcuggccuucucccucaugaagucccugggcgggggccgccgggggacgggcgcgcagggcgagacccugggggagaaguggaagcgccagcucaaccagcuguccaagcccgaguucaacaccuacaagcggagcggcaucauggagguggaccgcagcgaggccaaggaggggcugaagcggggcgagaccaccaagcacgccgugucccgcgggacggccaagcuccggugguucgucgagcgcaaccuggugaagcccgagggcaaggugaucgaccugggcugcgggcggggcggguggagcuacuacugcgcgggccucaagaaggucaccgaggugaagggguacaccaagggcggcccggggcacgaggagcccauccccauggccaccuacggcuggaaccuggugaagcugcacuccgggaaggacgucuucuucaugcccccggagaagugcgacacgcugcucugcgacaucggcgagagcucccccaaccccaccaucgaggaggggcgcacccugcgggugcugaagaugguggagcccuggcuccgcggcaaccaguucugcaucaagauccugaacccguacaugcccagcgucguggagacccuggagcagaugcagcggaagcacggcgggaugcucgugcgcaacccccugucccggaacagcacgcacgagauguacugggucuccugcggcaccgggaacaucgugagcgccgugaacaugaccucccgcaugcugcucaaccgcuucaccauggcccaccggaagcccacguacgagcgcgacgucgaccugggcgccggcacccggcacguggcgguggagccggaggucgccaaccuggacaucaucgggcagcgcaucgagaacaucaagaacgagcacaagagcaccuggcacuacgacgaggacaaccccuacaagaccugggccuaccacggcuccuacgaggugaagcccagcggguccgccagcuccauggugaacggcgucgugcggcuccugacgaagcccugggacgucaucccgauggugacccagaucgccaugaccgacaccacgcccuucgggcagcagcgcguguucaaggagaaggucgacacccggacgccccgggcgaagcggggcaccacgcagaucauggaggugaccgccaaguggcuguggggcuuccucagccgcaacaagaagccgcggaucugcacccgcgaggaguucacccggaaggugcgcuccaacgccgccaucggggccgucuucguggacgagaaccaguggaacagcgcgaaggaggccguggaggacgagcgguucugggaccugguccaccgcgagcgggagcugcacaagcagggcaagugcgccacgugcguguacaacaugauggggaagcgcgagaagaagcucggcgaguucgggaaggccaagggcagccgggcgaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacccgcaucaccgaggacgaccugcagaacgaggcgaagaucacggacaucauggagcccgagcacgcccuccuggccaccuccaucuucaagcugaccuaccagaacaaggucgugcgggugcagcgccccgccaagaacggcaccgucauggacgugaucagccggcgcgaccagcggggguccggccaggugggcacguacgggcucaacaccuucaccaacauggagguccagcugauccgccagauggagagcgagggcaucuuccugccguccgagcucgagacccccaaccuggccgagcgggugcuggacuggcucgagaagcacggggcggagcgccugaagcggauggccaucagcggcgacgacugcguggucaagcccaucgacgaccgcuucgccaccgcccugacggcccucaacgacauggggaaggugcggaaggacaucccccagugggagccguccaagggcuggaacgacuggcagcagguccccuucugcagccaccacuuccaccagcugaucaugaaggacggccgcgagaucgucgugcccugccggaaccaggacgagcugguggggcgcgcgcgggucucccagggcgccggguggagccuccgcgagaccgccugccugggcaaguccuacgcccagauguggcagcugauguacuuccaccggcgcgaccuccggcuggccgcgaacgccaucugcagcgccgugcccguggacugggucccgaccucccgcaccacguggagcauccacgcccaccaccaguggaugaccaccgaggacaugcugagcguguggaaccgcguguggaucgaggagaaccccuggauggaggacaagacccacgucuccagcugggaggaggugcccuaccucgggaagcgggaggaccaguggugcggcucccugaucggccugacggcgcgcgccaccugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8143 - RNA, 9879 nt, Artificial Sequence
  derived and/or modified CDS sequence (opt1) from DENV-1__FJ024483__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuacacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacuccuucagcggcgucgagggggagggccugcacaagcucggguacauccugcgcgacaucuccaagaucccgggcggcaacauguacgcggacgacaccgccgggugggacacgcggaucaccgaggacgaccugcagaacgaggccaagaucaccgacaucauggagcccgagcacgcccuccuggccaccagcaucuucaagcugacguaccagaacaagguggugcgcguccagcgccccgcgaagaacggcaccgugauggacgugaucucccggcgcgaccagcgggggagcggccaggucggcaccuacgggcucaacaccuucacgaacauggaggugcagcugauccgccagauggaguccgagggcaucuuccugcccagcgagcucgagaccccgaaccuggccgagcgggugcuggacuggcucgagaagcacggggccgagcgccugaagcggauggccaucuccggcgacgacugcgucgugaagcccaucgacgaccgcuucgccaccgcgcugaccgcccucaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcuggucgggcgcgcccgggugagccagggcgccggguggucccuccgcgagaccgccugccugggcaagagcuacgcgcagauguggcagcugauguacuuccaccggcgcgaccuccggcuggccgccaacgccaucugcuccgcggugcccgucgacugggugcccacgagccgcaccaccuggagcauccacgcccaccaccaguggaugaccacggaggacaugcuguccguguggaaccgggucuggaucgaggagaacccguggauggaggacaagacccacgugagcuccugggaggaggugcccuaccucgggaagcgcgaggaccaguggugcggcagccugaucggccugaccgcccgcgccaccugggccacgaacauccaggucgcgaucaaccaggugcggcgccucaucgggaacgagaacuaccuggacuacaugaccuccaugaagcgguucaagaacgagagcgaccccgagggcgcccugugguga

SEQ ID NO: 8144 - RNA, 9879 nt, Artificial Sequence
  derived and/or modified CDS sequence (opt1) from DENV-1__EU596504__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcuucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcuguacagcgggaaggacguguucuucaugccgcccgagaagugcgacacccuccugugcgacaucggcgaguccagcccgaaccccaccaucgaggaggggcgcacgcugcggauccucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugcggcugcugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgcgaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccacgagccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggccacgaacauccagguggcgaucaaccagguccggcgccugaucgggaacgagaacuaccuggacuacaugaccuccaugaagcgguucaagaacgagagcgaccccgagggcgcccucugguga

SEQ ID NO: 8145 - RNA, 9879 nt, Artificial Sequence
  derived and/or modified CDS sequence (opt1) from DENV-1__FJ024481__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcuguacagcgggaaggacguguucuucaugccgcccgagaagugcgacacccuccugugcgacaucggcgaguccagcccgaaccccaccaucgaggaggggcgcacgcugcggauccucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugcggcugcugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgcgaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccacgagccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggccacgaacauccagguggcgaucaaccagguccggcgccugaucgggaacgagaacuaccuggacuacaugaccuccaugaagcgguucaagaacgagagcgaccccgagggcgcccucugguga

SEQ ID NO: 8146 - RNA, 9879 nt, Artificial Sequence
  derived and/or modified CDS sequence (opt1) from DENV-1__GQ199872__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccaccaucgaggaggggcgcacgcugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcaccgggaacaucguguccgccgucaacaugacgagccgcaugcuccugaaccgguucaccauggcgcaccgcaagcccaccuacgagcgcgacguggaccugggcgccggcacccggcacguggccgucgagcccgagguggccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggucaacggcguggugcggcugcugaccaagcccugggacgucauccccauggugacccagaucgccaugacggacaccaccccguucgggcagcagcgcgucuucaaggagaagguggacacccggacgccccgcgccaagcggggcaccacccagaucauggaggugaccgccaaguggcucuggggcuuccugucccgcaacaagaagccccggaucugcacgcgcgaggaguucacccggaagguccgcagcaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaagguggugcgcguccagcgccccgcgaagaacggcaccgugauggacgugaucucccggcgcgaccagcgggggagcggccaggucggcaccuacgggcugaacaccuucacgaacauggaggugcagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcgucgugaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccuggagcauccacgcccaccaccaguggaugaccacggaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgcgccaccugggccacgaacauccaggucgcgaucaaccaggugcggcgccugaucgggaacgagaacuaccuggaccacaugaccuccaugaagcgguucaagaacgagagcgaccccgagggcgcccucugguga

SEQ ID NO: 8147 - RNA, 9879 nt, Artificial Sequence
  derived and/or modified CDS sequence (opt1) from DENV-1__FJ410290__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggggagcucugcgaggacaccaugaccuacaagugcccccagaucaccgaggccgagcccgacgacguggacugcuggugcaacgccaccgacaccugggucaccuacgggaccugcagccagaccggggagcaccggcgggagaagcgcuccguggcccuggcgccccacgugggccuggggcucgagacgcggaccgagaccuggaugagcuccgagggcgccuggaagcagauccagcgggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccagccccgcgauccuccgcaagcugugcaucgaggccaagaucuccaacaccaccacggacagccggugcccgacccagggcgaggccacccugguggaggagcaggacgccaacuucgugugccgccggaccuucgucgaccgcggcugggggaacggcugcggccucuucggcaaggggucccugcugacgugcgccaaguucaagugcgugaccaagcucgagggcaagaucgugcaguacgagaaccugaaguacagcgucaucgugaccgugcacaccggcgaccagcaccaggucgggaacgagacgaccgagcacggcaccaucgcgaccaucacgccccaggcccccacguccgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccagcggggccagcaccucccaggagaccuggaaccgccaggaccuccuggugacguucaagaccgcccacgcgaagaagcaggagguggucgugcugggcagccaggagggcgccaugcacaccgcccucaccggggccacggagauccagaccuccggcaccaccacgaucuucgccgggcaccugaagugccggcugaagauggacaagcucacccugaagggcaccagcuacgugaugugcaccggguccuucaagcuggagaaggaggucgcggagacgcagcacggcaccgugcuggugcaggucaaguacgagggcaccgacgcccccugcaagauccccuucagcacccaggacgagaagggggugacgcagaacggccgccucaucaccgccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccacggcccgcggggcccgccggauggccauccucggcgacaccgcgugggacuucggguccaucggcggcgucuucaccagcguggggaagcuggugcaccaggucuucggcaccgccuacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgcgagcugaagugcgggagcggcaucuucgugaccaacgagguccacaccuggaccgagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacagcuacacccagaugugcgaccaccggcugauguccgcggccaucaaggacagcaaggccguccacgccgacaugggcuacuggaucgaguccgagaagaacgagaccuggaagcuggcccgcgcgagcuucaucgaggugaagacgugcaccuggcccaagucccacacccucuggagcaacggcgugcuggaguccgagaugaucauccccaagaucuacgggggcccgaucagccagcacaacuaccggcccggguacuucacccagacggccggccccuggcaccuggggaagcucgagcuggacuucgaccugugcgagggcaccaccgucgugguggacgagcacugcggcaaccgcgggccgucccuccggaccacgaccgucaccggcaagaucauccacgaguggugcugccgcagcugcacccugccgccccugcgguuccgcggggaggacggcugcugguacgggauggagauccggcccgugaaggagaaggaggagaaccucgugcgcuccauggucagcgccggcagcggcgagguggacuccuucagccuggggauccugugcguguccaucaugaucgaggaggucaugcggagccgcuggucccggaagaugcucaugacgggcacccuggugguguuccugcuccugaucauggggcagcugaccuggaaggaccucauccgccugugcaucauggucggcgccaacgccagcgaccgcauggggaugggcaccacguaccuggcgcucauggccaccuucaagaugcggccgauguucgccgugggccugcuguuccgccggcucaccucccgcgaggugcugcugcucaccaucgggcugagccuggucgccuccguggagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgcguggaagaccaccgccauggcccuguccaucgucagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccaucggcaucguguccauccugcucagcagccugcugaagaacgacgucccccucgcggggccgcugaucgccggcggcaugcugaucgccugcuacgugaucuccgggagcuccgccgaccucagccuggagaaggccgcggagguguccugggagcaggaggccgagcacagcggcaccucccacaacauccuggucgaggugcaggacgacgggaccaugaagaucaaggacgaggagcgcgacgacacccucacgauccugcugaaggccacccuccuggccgugagcggcgucuaccccauguccauccccgccacccuguucgugugguacuucuggcagaagaagaagcagcggagcggggugcucugggacacccccuccccgcccgaggucgagcgcgcggugcuggacgacggcaucuaccggauccugcagcgcggccugcucgggcggagccaggugggcgucgggguguuccaggacggcguguuccacacgauguggcacgucacccgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacgcccggcaccuucaagacccccgagggcgaggugggggccaucgcgcuggacuucaagcccggcaccuccgggagcccgaucgugaaccgggagggcaagaucgucggccuguacgggaacggcguggugacgaccuccgggaccuacgucagcgccaucgcccaggccaaggccagccaggagggcccccuccccgagaucgaggacgagguguucaagaagcgcaaccugaccaucauggaccugcacccgggguccggcaagacgcggcgcuaccuccccgcgaucgugcgggaggccaucaagcgcaagcugcggacccugauccucgcccccacccgcgucguggccagcgagauggcggaggcccugaagggcaugcccauccgcuaccagaccacggccgugaaguccgagcacaccgggcgggagaucgucgaccugaugugccacgccaccuucaccaugcgccuccugagcccggugcgggugcccaacuacaacaugaucaucauggacgaggcccacuucacggaccccgcguccaucgccgcccgcggcuacaucagcacccgggucgggaugggcgaggccgccgcgaucuucaugaccgccacgccgcccggguccguggaggccuucccccagagcaacgccgugauccaggacgaggagcgcgacauccccgagcgguccuggaacagcggcuacgacuggaucacggacuuccccggcaagaccgucugguucgugcccuccaucaagagcgggaacgacaucgccaacugccugcgcaagaacggcaagcgggugauccagcucucccgcaagaccuucgacaccgaguaccagaagacgaagaacaacgacugggacuacgucgugaccaccgacaucagcgagaugggggcgaacuuccgggccgaccgcgugaucgacccccggcgcugccugaagcccgucauccugaaggacggccccgagcgggugauccucgccgggccgaugcccgugaccgucgccuccgcggcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcccggaccuacagcgacccgcucgcgcugcgcgaguucaaggaguucgccgccgggcggcgcagcguguccggcgaccugauccucgagaucggcaagcugccccagcaccugacgcuccgggcccagaacgcccuggacaaccuggucaugcuccacaacagcgagcagggcgggaaggcguaccgccacgccauggaggagcugcccgacaccaucgagacccugaugcuccuggcccugaucgccgugcucaccgggggcgugacgcuguucuuccuguccgggaagggccucggcaagaccagcaucgggcugcugugcgucaccgcguccagcgcccuccuguggauggccuccguggagccccacuggaucgccgccagcaucauccuggaguucuuccucauggugcugcugaucccggagcccgaccggcagcgcacgccccaggacaaccagcucgcguacgucgugaucggccugcuguucaugauccucacgguggccgccaacgagauggggcugcuggagaccaccaagaaggaccucggcaucgggcacgucgccgccgagaaccaccagcacgcgaccaugcuggacguggaccugcggccggccuccgccuggacgcucuacgccguggccaccaccgucaucacccccaugaugcgccacacgaucgagaacaccaccgcgaacaucagccugaccgccaucgccaaccaggccgccauccugaugggccucgacaagggcuggcccaucuccaagauggacaucggggugccccugcuggcgcucggcugcuacagccaggugaacccgcugacgcugaccgccgccguccucaugcugguggcccacuacgcgaucaucgggcccggccugcaggccaaggccacccgggaggcccagaagcgcaccgccgcggggaucaugaagaaccccacgguggacggcaucgucgccaucgaccucgaccccgugguguacgacgccaaguucgagaagcagcugggccagaucaugcugcucauccugugcaccucccagauccugcucaugcgcaccaccugggcccugugcgagagcaucacgcuggccaccgggccgcucaccacccugugggagggcucccccgggaaguucuggaacacgaccaucgcggucagcauggccaacaucuuccggggcuccuaccuggccggcgccgggcucgccuucagccugaugaagucccugggcgggggccgccgggggaccggcgcgcagggcgagacccucggggagaaguggaagcgccagcugaaccagcugagcaagagcgaguucaacacguacaagcgguccggcaucauggagguggaccgcuucgaggccaaggaggggcucaagcggggcgagaccaccaagcacgccgugagccgcgggaccgccaagcugcggugguucgucgagcgcaaccuggugaagcccgagggcaaggugaucgaccugggcugcgggcggggcgggugguccuacuacugcgcgggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcccaccgcaagcccaccuacgagcgcgacgucgaccugggcgccggcacccggcacguggcgguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggugaacggcgucgugaagcugcugaccaagcccugggacgucauccccauggugacccagaucgccaugacggacaccaccccguucgggcagcagcggguguucaaggagaaggucgacacccgcacgccccgggcgaagcgcggcaccacccagaucauggaggugaccgccaaguggcucuggggcuuccugucccggaacaagaagccccgcaucugcacgcgggaggaguucacccgcaaggugcggagcaacgccgccaucggggccgucuucguggacgagaaccaguggaacagcgcgaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcucccgcgcgaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgccgacgacaccgccgggugggacacgcgcaucaccgaggacgaccuccagaacgaggcgaagaucaccgacaucauggagcccgagcacgcccugcuggccaccagcaucuucaagcucacguaccagaacaaggucgugcgggugcagcgccccgccaagaacggcaccgucauggacgugaucucccgccgggaccagcgcgggagcggccaggugggcaccuacgggcugaacaccuucacgaacauggagguccagcugauccggcagauggaguccgagggcaucuuccuccccagcgagcuggagaccccgaaccuggccgagcgcgugcucgacuggcuggggaagcacggcgcggagcggcugaagcgcauggccaucuccggggacgacugcguggucaagcccaucgacgaccgguucgccaccgcccucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcucgugggccgggcgcgcgucagccagggggccggcuggucccugcgggagaccgccugccugggcaagagcuacgcccagauguggcagcucauguacuuccaccgccgggaccugcgccuggccacgaacgcgaagugcuccgccgugcccguggacuggguccccaccagccggaccaccuggagcauccacgcccaccaccaguggaugacgaccgaggacaugcucuccguguggaaccgcguguggaucgaggagaacccguggauggaggacaagacccacgucagcuccugggaggaggugcccuaccugggcaagcgggaggaccaguggugcggcagccugaucgggcucaccgcccgcgcgacgugggccaccaacauccagguggccaucaaccagguccgccggcugaucggcaacgagaacuaccuggacuacaugaccuccaugcgccgguucaagaacgagagcgaccccgagggggcccucugguga

SEQ ID NO: 8148 - RNA, 9879 nt, Artificial Sequence
  derived and/or modified CDS sequence (opt1) from DENV-1__FJ024423__SS-prME
agcgugaccaugcugcucaugcugcugcccaccgcccucgccuuccaccugaccacccggggcggggagccccacaugaucgugagcaagcaggagcggggcaagagccuccucuucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugguggccuucuuccuggcgcacgccaucggcaccagcaucacccagaaggggaucaucuucauccuccugaugcuggucacccccuccauggccaugcgcugcgugggcaucggcaaccgggacuucguggaggggcucagcggcgccacgugggucgacguggugcuggagcacggguccugcgucaccaccauggccaagaacaagcccacccuggacaucgagcuccugaagacggaggugaccaaccccgcgauccugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaucaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccgccaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccggcugaagauggacaagcugacgcucaagggcaccuccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucgugaucggcgccggcgagaaggcgcucaagcuguccugguucaagaaggggagcuccaucggcaagauguucgaggccaccgcccgcggggcccgccggauggccauccugggcgacacggcgugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccugugguccaacggcgugcucgagagcgagaugaucauccccaagaucuacgggggcccgaucucccagcacaacuaccggcccggguacuucacccagaccgccggccccuggcaccuggggaagcuggagcucgacuucgaccugugcgagggcacgaccgucgugguggacgagcacugcggcaaccgcgggccgagccugcggaccaccacggucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgccagcaucaugaucgaggaggugaugcggucccgcuggagccggaagaugcugaugaccggcacgcucgccgucuuccugcugcucaucauggggcagcugaccuggaacgaccugauccgccucugcaucauggugggcgcgaacgccuccgaccgcauggggaugggcaccaccuaccuggcccugauggccacguucaagaugcggccgauguucgccgugggccuccuguuccgccggcugaccagccgcgagguccuccugcugaccaucgggcucucccugguggcgagcguggagcugcccaacucccucgaggagcugggcgacgggcuggccaugggcaucaugaugcucaagcugcugaccgaguuccagccccaccagcucuggacgacccugcugagccucaccuucaucaagaccacgcugucccuggacuacgccuggaagaccaccgccauggcgcucagcaucgucucccuguucccccugugccucagcaccacgucccagaagaccaccuggcugccggugcugcucggcagcuucgggugcaagccccugaccauguuccugaucaccgagaacaagaucuggggccggaaguccuggccccucaacgaggggaucauggccaucggcaucgucagcauccugcuguccagccuccugaagaacgacgugccccuggccgggccgcucaucgccggcggcaugcugaucgccugcuacgugaucagcggguccagcgcggaccugucccucgagaaggccgccgaggucagcugggagcaggaggccgagcacuccggcacgagccacaacauccugguggaggugcaggacgacgggaccaugaagaucaaggacgaggagaaggacgacacccugaccauccuccugaaggccacgcugcucgcggucuccggcguguaccccaugagcauccccgccacccuguucgugugguacuucuggcagaagaagaagcagcgcuccgggguccugugggacacccccagcccgcccgagguggagcgggccgugcucgacgacggcaucuaccgcauccugcagcggggccugcuggggcgcucccaggucggcguggggguguuccaggacggcgucuuccacaccauguggcacgugacgcgcggggccgugcucauguaccagggcaagcgccuggagcccagcugggccuccgucaagaaggaccugaucagcuacggcgggggcuggcgguuccagggguccuggaacaccggcgaggagguccaggugaucgcggucgagcccgggaagaacccgaagaacgugcagaccacccccggcacguucaagacccccgagggcgaggugggggccaucgcccucgacuucaagcccggcaccagcggguccccgaucgucaaccgcgagggcaagaucgugggccuguacgggaacggcguggucaccacgagcgggaccuacguguccgccaucgcccaggcgaaggccagccaggagggcccccugcccgagaucgaggacgagguguucaagaagcggaaccucaccaucauggaccugcacccggggagcggcaagacccgccgguaccugcccgccaucguccgcgaggccaucaagcggaagcuccgcacgcugauccuggcgcccacccgggugguggccuccgagauggccgaggcccucaagggcaugcccauccgcuaccagaccaccgccgucaagagcgagcacacggggcgcgagaucguggaccugaugugccacgcgaccuucaccaugcggcugcucuccccggugcgcguccccaacuacaacaugaucaucauggacgaggcccacuucaccgaccccgccagcaucgccgcccggggcuacaucuccacgcgcguggggaugggcgaggcggccgccaucuucaugaccgccacgccgcccgggagcguggaggccuucccccaguccaacgcggucauccaggacgaggagcgggacauccccgagcgcagcuggaacuccggcuacgacuggaucaccgacuuccccggcaagacggugugguucgugcccagcaucaaguccgggaacgacaucgccaacugccugcggaagaacggcaagcgcgucauccagcugagccggaagaccuucgacaccgaguaccagaagaccaagaacaacgacugggacuacguggugacgaccgacaucuccgagaugggggccaacuuccgcgccgaccgggucaucgacccccgccggugccucaagcccgugauccugaaggacggccccgagcgcgugauccuggcggggccgaugcccgucaccguggccagcgccgcccagcggcgcggccggaucggccgcaaccagaacaaggagggggaccaguacguguacaugggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugcgcggggaggcccggaagaccuucgucgagcugaugcgccggggcgaccuccccguguggcugagcuacaaggucgcguccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccgcuggcccuccgggaguucaaggaguucgccgccgggcgccggagcgucagcggcgaccugauccuggagaucggcaagcucccccagcaccugacccugcgcgcgcagaacgcccucgacaaccuggugaugcugcacaacuccgagcagggcgggaaggccuaccggcacgccauggaggagcuccccgacacgaucgagacccugaugcugcucgcgcugaucgccgugcugaccgggggcgucacccucuucuuccugagcgggaagggccugggcaagacguccaucgggcuccugugcgugaccgccagcuccgcccugcucuggauggccagcguggagccccacuggaucgcggccuccaucauccuggaguucuuccugaugguccuccugaucccggagcccgaccgccagcggacgccccaggacaaccagcuggccuacguggugaucggccuccuguucaugauccugaccgucgccgccaacgagauggggcuccuggagacgaccaagaaggaccugggcaucgggcacguggcggccgagaaccaccagcacgccaccaugcucgacguggaccugcgcccggccagcgccuggacccuguacgcggucgccacgaccgugaucacccccaugaugcggcacaccaucgagaacacgaccgccaacaucucccucaccgccaucgccaaccaggcggccauccugaugggccuggacaagggcuggcccaucagcaagauggacaucggggugccccuccuggcccugggcugcuacucccaggucaacccgcucacccugacggccgcggugcugaugcucguggcccacuacgccaucaucgggcccggccugcaggccaaggccacccgcgaggcgcagaagcggaccgccgccgggaucaugaagaaccccaccgucgacggcaucguggccaucgaccuggaccccguggucuacgacgccaaguucgagaagcagcucggccagaucaugcugcugauccucugcacgagccagauccugcugaugcgcaccaccugggcgcucugcgaguccaucacccuggccacggggccgcugaccacccucugggagggcagccccgggaaguucuggaacaccacgaucgccguguccauggccaacaucuuccgcggcagcuaccuggccggcgcggggcuggccuucucccucaugaagucccugggcgggggccggcgcgggaccggcgcccagggcgagacccugggggagaaguggaagcggcagcucaaccagcuguccaagagcgaguucaacaccuacaagcgcagcggcaucauggagguggaccgguccgaggccaaggaggggcugaagcgcggcgagacgaccaagcacgcggucagccgggggaccgccaagcuccgcugguucguggagcggaaccuggugaagcccgagggcaaggucaucgaccugggcugcgggcgcggcgggugguccuacuacugcgccggccugaagaaggugaccgaggugaagggguacaccaagggcggccccgggcacgaggagccgauccccauggccacguacggcuggaaccucgucaagcugcacagcgggaaggacguguucuucaugccgcccgagaagugcgacacccugcucugcgacaucggcgaguccagcccgaaccccaccaucgaggaggggcggacccugcgcgugcugaagauggucgagcccuggcuccggggcaaccaguucugcaucaagauccugaaccccuacaugccguccgugguggagacgcuggagcagaugcagcgcaagcacggcgggaugcucguccggaacccccugagccgcaacuccacccacgagauguacugggugagcugcggcaccgggaacaucguguccgccgucaacaugaccagccggaugcugcucaaccgcuucacgauggcgcaccggaagcccaccuacgagcgcgacguggaccugggcgccggcacccgccacguggccgucgagcccgagguggccaaccuggacaucaucgggcagcggaucgagaacaucaagaacgagcacaaguccaccuggcacuacgacgaggacaacccguacaagacgugggccuaccacggcagcuacgaggugaagcccuccgggagcgcguccagcauggucaacggcguggugcgccuccugaccaagcccugggacgucauccccauggugacccagaucgccaugaccgacacgaccccguucgggcagcagcgggucuucaaggagaagguggacacccgcacgccccgggccaagcgcggcacgacccagaucauggaggugaccgccaaguggcuguggggcuuccucucccggaacaagaagccccgcaucugcacccgggaggaguucacgcgcaagguccggagcaacgccgcgaucggggccguguucguggacgagaaccaguggaacagcgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcucccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucuccaagaucccgggcggcaacauguacgcggacgacaccgccgggugggacacccgcaucacggaggacgaccugcagaacgaggccaagaucaccgacaucauggagcccgagcacgcccuccuggccaccagcaucuucaagcugaccuaccagaacaagguggugcggguccagcgccccgcgaagaacggcacggugauggacgugaucucccgccgggaccagcgcgggagcggccaggucggcaccuacgggcucaacaccuucaccaacauggaggugcagcugauccggcagauggaguccgagggcaucuuccugcccagcgagcucgagacgccgaaccuggccaagcgcgugcuggacuggcucgagaagcacggggccgagcggcugaagcgcauggccaucuccggcgacgacugcgucgugaagcccaucgacgaccgguucgccaccgcgcugaccgcccucaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcuggucgggcgggcccgcgugagccagggcgccggguggucccuccgggagaccgccugccugggcaagagcuacgcgcagauguggcagcugauguacuuccaccgccgggaccuccgccuggccgccaacgccaucugcuccgcggugcccgucgacugggugcccaccagccggacgaccuggagcauccacgcccaccaccaguggaugaccaccgaggacaugcuguccguguggaaccgcgucuggaucgaggagaacccguggauggaggacaagacgcacgugagcuccugggaggaggugcccuaccucgggaagcgggaggaccaguggugcggcagccugaucggccugaccgcccgcgccaccugggccaccaacauccaggucgcgaucaaccaggugcgccggcucaucgggaacgagaacuaccuggacuacaugacguccaugaagcgcuucaagaacgagagcgaccccgagggcgcccugugguga

SEQ ID NO: 8149 - RNA, 9879 nt, Artificial Sequence
  derived and/or modified CDS sequence (opt1) from DENV-1__FJ547089__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaccauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugaccggcacccuggccgucuuccugcuccugaucauggggcagcugaccuggaacgaccucauccgccugugcaucauggugggcgcgaacgccuccgaccgcauggggaugggcacgaccuaccuggcccucauggccaccuucaagaugcggccgauguucgccgugggccugcuguuccgccggcucaccagccgcgagguccugcugcucacgaucgggcugucccugguggcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgucucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggcggucuccggcguguaccccaugagcauccccgccacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagacgacccccggcaccuucaagacccccgagggcgaggugggggccaucgcccuggacuucaagcccggcacgagcggguccccgaucgucaaccgggagggcaagaucgugggccuguacgggaacggcguggucaccaccagcgggaccuacguguccgccaucgcccaggcgaaggccagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcgcccacccgcgugguggccuccgagauggccgaggcccugaagggcaugcccauccgcuaccagacgaccgccgucaagagcgagcacaccgggcgggagaucguggaccugaugugccacgcgaccuucacgaugcgccuccuguccccggugcggguccccaacuacaacaugaucaucauggacgaggcccacuucaccgaccccgccagcaucgccgcccgcggcuacaucuccacccggguggggaugggcgaggcggccgccaucuucaugaccgccacgcccccggggagcguggaggccuucccccaguccaacgcggucauccaggacgaggagcgcgacauccccgagcggagcuggaacuccggcuacgacuggaucaccgacuuccccggcaagaccgugugguucgugccgagcaucaaguccgggaacgacaucgccaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucacgguggccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggacguacuccgacccgcucgcccugcgcgaguucaaggaguucgccgccgggcggcgcagcgucagcggcgaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccggcggggucacccuguucuuccugagcgggaaggggcucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagaaggaccucggcaucgggcacguggcggccgagaaccaccagcacgccacgaugcuggacguggaccugcggccggccagcgccuggacccucuacgcggucgccaccaccgugaucacgcccaugaugcgccacaccaucgagaacaccaccgccaacaucucccugacggccaucgccaaccaggcggccauccugaugggccucgacaagggcuggcccaucagcaagauggacaucggggugccccugcuggcccucggcugcuacucccaggucaacccgcugacccugaccgccgcggugcucaugcugguggcccacuacgccaucaucgggcccggccugcaggccaaggccacccgggaggcgcagaagcgcacggccgccgggaucaugaagaaccccaccgucgacggcaucguggccaucgaccucgaccccguggucuacgacgccaaguucgagaagcagcugggccagaucaugcugcucauccugugcaccagccagauccugcucaugcgcaccacgugggcgcugugcgaguccaucacccuggccaccgggccgcucaccacgcugugggagggcagccccgggaaguucuggaacaccaccaucgccguguccauggccaacaucuuccggggcagcuaccuggccggcgcggggcucgccuucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgcggucagccgcgggaccgccaagcugcggugguucguggagcgcaaccuggugaagcccgagggcaaggucaucgaccugggcugcgggcggggcgggugguccuacuacugcgccggccucaagaaggugacggaggugaagggguacaccaagggcguccccgcccgcgaggagccgauccccauggccaccuacggcuggaaccuggugaagcugcacagcgggaaggacguguucuucaugccgcccgagaagugcgacacccuccugugcgacaucggcgaguccagcccgaaccccacgaucgaggaggggcggacccugcgcguccucaagaugguggagcccuggcugcggggcaaccaguucugcaucaagauccugaaccccuacaugccguccguggucgagacccucgagcagaugcagcgcaagcacgggggcaugcuggugcggaacccccugagccgcaacuccacccacgagauguacugggugagcugcggcacggggaacaucgucuccgcggugaacaugaccagccggaugcuccugaaccgcuucaccauggcccaccgcaagcccaccuacgagcgggacguggaccugggcgccgggacgcgccacgucgccguggagcccgagguggccaaccucgacaucaucggccagcggaucgagaacaucaagaacgagcacaaguccaccuggcacuacgacgaggacaacccguacaagaccugggcguaccacggcagcuacgaggucaagcccuccgggagcgccuccagcauggugaacggcgugguccgccugcugaccaagcccugggacgugauccccauggucacgcagaucgccaugaccgacaccaccccguucgggcagcagcggguguucaaggagaagguggacacgcgcacgccccgggccaagcgcggcaccacccagaucauggaggucacggccaaguggcucuggggguuccugucccggaacaagaagccccgcaucugcacccgggaggaguucacccgcaaggugcggagcaacgcggccaucggcgccguguucaucgacgagaaccaguggaacagcgccaaggaggcggucgaggacgagcgcuucugggaccuggugcaccgggagcgcgagcuccacaagcagggcaagugcgcgaccugcguguacaacaugauggggaagcgggagaagaagcugggcgaguucgggaaggccaagggcucccgcgccaucugguacauguggcugggggcccgguuccucgaguucgaggcgcugggcuucaugaacgaggaccacugguucagccgcgagaacucccugagcggcgucgagggggagggccuccacaagcugggguacauccugcgggacaucuccaagaucccgggcgggaacauguacgccgacgacacggccggcugggacacccgcgugaccgaggacgaccuccagaacgaggccaagaucaccgacaucauggagcccgagcacgcccugcuggcgacgagcaucuucaagcucaccuaccagaacaaggugguccgcgugcagcggcccgccaagaacggcaccgugauggacgucaucucccgccgggaccagcgcgggagcggccagguggggaccuacggccugaacacguucaccaacauggaggugcagcugauccggcagauggaguccgagggcaucuuccuccccagcgagcuggagaccccgaaccuggccgagcgcguccucgacuggcuggagaagcacggggccgagcggcugcgccggauggccaucuccggcgacgacugcguggugaagcccaucgacgaccgcuucgcgaccgcccucaccgcccugaacgacauggggaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcccgggugagccagggcgccggguggucccugcgcgagacggcgugccugggcaagagcuacgcccagauguggcagcucauguacuuccaccggcgcgaccugcggcuggccgccaacgcgaucugcuccgccguccccguggacugggugcccaccagccgcaccaccuggagcauccacgcccaccaccaguggaugacgaccgaggacaugcucuccgucuggaaccgcguguggaucgaggagaacccguggauggaggacaagacccacgugagcuccugggaggagguccccuaccuggggaagcgggaggaccaguggugcggcagccugaucgggcucaccgcccgcgccacgugggcgaccaacauccagguggccaucaaccaggugcggcgccugaucggcaacgagaacuaccuggacuacaugaccuccaugaagcgguucaagaacgagagcgaccccgagggcgcccucugguga

SEQ ID NO: 8150 - RNA, 9879 nt, Artificial Sequence
  derived and/or modified CDS sequence (opt1) from DENV-1__FJ024484__SS-prME
agcgugaccaugcugcucaugcugcugcccaccgcccucgccuuccaccugaccacccggggcggggagccccacaugaucgugagcaagcaggagcggggcaagagccuccucuucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcacccgggguucacggugguggccuucuuccuggcgcacgccaucggcaccagcaucacccagaaggggaucaucuucauccuccugaugcuggucacccccuccauggccaugcgcugcgugggcaucggcaaccgggacuucguggaggggcucagcggcgccacgugggucgacguggugcuggagcacggguccugcgucaccaccauggccaagaacaagcccacccuggacaucgagcuccugaagacggaggugaccaaccccgcgauccugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccugaucaccgccaacccgaucgucaccgacaaggagaagcccgugaacaucgagaccgagccgcccuucggggagagcuacaucgugaucggcgccggcgagaaggcgcucaagcuguccugguucaagaaggggagcuccaucggcaagauguucgaggccacggcccgcggggcccgccggauggccauccugggcgacaccgcgugggacuucgggagcaucggcggcgucuucaccuccguggggaagcucgugcaccaggucuucggcaccgccuacggggugcuguucagcggcguguccuggacgaugaagaucgggaucggcauccugcucaccuggcugggccugaacagccgcuccaccagccucuccaugaccugcaucgccgucgggauggugacgcuguaccugggcgugaugguccaggccgacagcgggugcgugaucaacuggaagggccgcgagcucaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacgguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacgaccagcgggccuggaacaucugggagguggaggacuacggcuucgggaucuucacgaccaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccugugguccaacggcgugcucgagagcgagaugaucauccccaagaucuacgggggcccgaucucccagcacaacuaccggcccggguacuucacccagacggccggccccuggcaccuggggaagcuggagcucgacuucgaccugugcgagggcaccaccgucgugguggacgagcacugcggcaaccgcgggccgagccugcggaccacgaccgucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgccagcaucaugaucgaggaggugaugcggucccgcuggagccggaagaugcugaugacgggcacccucgccgucuuccugcugcucaucauggggcagcugaccuggaacgaccugauccgccucugcaucauggugggcgcgaacgccuccgaccgcauggggaugggcaccacguaccuggcccugauggccaccuucaagaugcggccgauguucgccgugggccuccuguuccgccggcugaccagccgcgagguccuccugcugaccaucgggcucucccugguggcgagcguggagcugcccaacucccucgaggagcugggcgacgggcuggccaugggcaucaugaugcucaagcugcugacggaguuccagccccaccagcucuggaccacccugcugagccucaccuucaucaagacgacccugucccuggacuacgccuggaagaccaccgccauggcgcucagcaucgucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggccaucggcaucgucagcauccugcuguccagccuccugaagaacgacgugccccuggccgggccgcucaucgccggcggcaugcugaucgccugcuacgugaucagcggguccagcgcggaccugucccucgagaaggccgccgaggucagcugggagcaggaggccgagcacuccggcaccagccacaacauccugguggaggugcaggacgacgggaccaugaagaucaaggacgaggagaaggacgacacccugacgauccuccugaaggccacccugcucgcggucuccggcguguaccccaugagcauccccgccacccuguucgugugguacuucuggcagaagaagaagcagcgcuccgggguccugugggacacccccagcccgcccgagguggagcgggccgugcucgacgacggcaucuaccgcauccugcagcggggccugcuggggcgcucccaggucggcguggggguguuccaggacggcgucuuccacacgauguggcacgugacccgcggggccgugcucauguaccagggcaagcgccuggagcccagcugggccuccgucaagaaggaccugaucagcuacggcgggggcuggcgguuccagggguccuggaacaccggcgaggagguccaggugaucgcggucgagcccgggaagaacccgaagaacgugcagaccacgcccggcaccuucaagacccccgagggcgaggugggggccaucgcccucgacuucaagcccggcaccagcggguccccgaucgucaaccgcgagggcaagaucgugggccuguacgggaacggcguggucacgaccagcgggaccuacguguccgccaucgcccaggcgaaggccagccaggagggcccccugcccgagaucgaggacgagguguucaagaagcggaaccucaccaucauggaccugcacccggggagcggcaagacgcgccgguaccugcccgccaucguccgcgaggccaucaagcggaagcuccgcacccugauccuggcgcccacccgggugguggccuccgagauggccgaggcccucaagggcaugcccauccgcuaccagaccacggccgucaagagcgagcacaccgggcgcgagaucguggaccugaugugccacgcgaccuucaccaugcggcugcucuccccggugcgcguccccaacuacaacaugaucaucauggacgaggcccacuucacggaccccgccagcaucgccgcccggggcuacaucuccacccgcguggggaugggcgaggcggccgccaucuucaugaccgccacgccgcccgggagcguggaggccuucccccaguccaacgcggucauccaggacgaggagcgggacauccccgagcgcagcuggaacuccggcuacgacuggaucacggacuuccccggcaagaccgugugguucgugcccagcaucaaguccgggaacgacaucgccaacugccugcggaagaacggcaagcgcgucauccagcugagccggaagaccuucgacaccgaguaccagaagacgaagaacaacgacugggacuacguggugaccaccgacaucuccgagaugggggccaacuuccgcgccgcgcgggucaucgacccccgccggugccucaagcccgugauccugaaggacggccccgagcgcgugauccuggccgggccgaugcccgucaccguggccagcgccgcccagcggcgcggccggaucggccgcaaccagaacaaggagggggaccaguacguguacaugggccagccccucaacaacgacgaggaccacgcgcacuggacggaggccaagaugcugcuggacaacaucaacacccccgaggggaucaucccggcccucuucgagcccgagcgggagaaguccgccgccaucgacggcgaguaccgccugcgcggggaggcgcggaagaccuucgucgagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccgcuggcccuccgggaguucaaggaguucgccgcggggcgccggagcgucagcggcgaccugauccuggagaucggcaagcucccccagcaccugacgcugcgcgcccagaacgcccucgacaaccuggugaugcugcacaacuccgagcagggcgggaaggccuaccggcacgcgauggaggagcuccccgacaccaucgagacccugaugcugcucgcccugaucgccgugcugaccgggggcgucacccucuucuuccugagcgggaagggccugggcaagaccuccaucgggcuccugugcgugaccgccagcuccgcccugcucuggauggcgagcguggagccccacuggaucgccgccuccaucauccuggaguucuuccugaugguccuccugaucccggagcccgaccgccagcggacgccccaggacaaccagcuggccuacguggugaucggccuccuguucaugauccugacggucgccgcgaacgagauggggcuccuggagaccaccaagaaggaccugggcaucgggcacguggccgccgagaaccaccagcacgccaccaugcucgacguggaccugcgcccggccagcgcguggacgcuguacgccgucgccaccaccgugaucacccccaugaugcggcacacgaucgagaacaccaccgccaacaucucccucaccgccaucgcgaaccaggccgccauccugaugggccuggacaagggcuggcccaucagcaagauggacaucggggugccccuccuggcccugggcugcuacucccaggucaacccgcucacgcugaccgcggccgugcugaugcucguggcccacuacgccaucaucgggcccggccugcaggccaaggcgacccgcgaggcccagaagcggaccgccgccgggaucaugaagaaccccacggucgacggcaucguggccaucgaccuggaccccguggucuacgacgcgaaguucgagaagcagcucggccagaucaugcugcugauccucugcaccagccagauccugcugaugcgcaccaccugggcccucugcgaguccaucacgcuggccaccgggccgcugaccacccucugggagggcagccccgggaaguucuggaacacgaccaucgccguguccauggccaacaucuuccgcggcagcuaccuggcgggcgccgggcuggccuucucccucaugaagucccugggcgggggccggcgcgggaccggcgcccagggcgagacccugggggagaaguggaagcggcagcucaaccagcugacgaaguccgaguucaacaccuacaagcgcagcggcaucauggagguggaccggagcgaggcgaaggaggggcugaagcgcggcgagaccaccaagcacgccgucucccgggggaccgccaagcuccgcugguucguggagcggaaccuggugaagcccgagggcaaggucaucgaccugggcugcgggcgcggcggguggagcuacuacugcgccggccugaagaaggugacggaggugaagggguacaccaagggcggccccgggcacgaggagccgauccccauggccaccuacggcuggaaccucgucaagcugcacuccgggaaggacggcuucuucaugccgcccgagaagugcgggacccugcucugcgacaucggcgagagcuccccgaaccccacgaucgaggagggccggacccugcgcgugcugaagaugguggagcccuggcuccgggggaaccaguucugcaucaagauccugaaccccuacaugccgagcgucguggagacccuggagcagaugcagcgcaagcacggcgggaugcucgugcggaacccccugucccgcaacagcacccacgagauguacugggucuccugcggcacgggcaacaucgugagcgcggugaacaugaccucccggaugcugcucaaccgcuucaccauggcccaccggaagcccaccuacgagcgcgacgucgaccugggggccggcacgcgccacguggccguggagcccgaggucgccaaccuggacaucaucgggcagcggaucgagaacaucaagaacgagcacaagagcaccuggcacuacgacgaggacaacccguacaagaccugggcguaccacggcuccuacgaggugaagcccagcggguccgccagcuccauggugaacggcgucgugcgccuccugaccaagcccugggacgugauccccauggucacgcagaucgccaugaccgacaccaccccguucggccagcagcggguguucaaggagaaggucgacacgcgcacgccccgggccaagcgcgggaccacccagaucauggaggugacggccaaguggcuguggggcuuccucagccggaacaagaagccccgcaucugcacccgggaggaguucacccgcaaggugcgguccaacgcggccaucggggccgucuucguggacgagaaccaguggaacagcgccaaggaggcgguggaggacgagcgcuucugggaccugguccaccgggagcgcgagcugcacaagcagggcaagugcgcgaccugcguguacaacaugauggggaagcgggagaagaagcucggcgaguucggcaaggccaaggggagccgcgccaucugguacauguggcugggcgcccgguuccuggaguucgaggcgcucggguucaugaacgaggaccacugguucucccgcgagaacagccuguccggcguggagggggagggccugcacaagcucggcuacauccugcgggacaucagcaagauccccggcgggaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagaacgggaccgucauggacgugaucagccgccgggaccagcgcggcuccggccaggugggcaccuacgggcucaacacguucaccaacauggagguccagcugauccggcagauggagagcgagggcaucuuccugcccuccgagcucgagaccccgaaccuggccaagcgcgugcuggacuggcucgagaagcacggggccgagcggcugaagcgcauggccaucagcggcgacgacugcguggucaagcccaucgacgaccgguucgcgaccgcccugaccgcccucaacgacaugggcaaggugcgcaaggacaucccccagugggagcccuccaagggguggaacgacuggcagcaggucccguucugcagccaccacuuccaccagcugaucaugaaggacggccgggagaucgucgugcccugccgcaaccaggacgagcugguggggcgggcccgcgucucccagggcgccggguggagccuccgggagacggcgugccugggcaaguccuacgcccagauguggcagcugauguacuuccaccgccgggaccuccgccuggccgccaacgcgaucugcagcgccgugcccguggacuggguccccaccucccggaccaccuggagcauccacgcccaccaccaguggaugacgaccgaggacaugcugagcguguggaaccgcguguggaucgaggagaacccguggauggaggacaagacccacgucuccagcugggaggaggugcccuaccucggcaagcgggaggaccaguggugcgggucccugaucggccugaccgcccgcgccacgugggcgaccaacauccagguggccaucaaccagguccgccggcucaucgggaacgagaacuaccuggacuacaugaccagcaugaagcgcuucaagaacgaguccgaccccgagggcgcccugugguga

SEQ ID NO: 8151 - RNA, 9879 nt, Artificial Sequence
  derived and/or modified CDS sequence (opt1) from DENV-1__EU596503__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaucgggagcuucaagcuggagaaggaggucgcggagacccagcacggcacggugcuggugcaggucaaguacgagggcaccgacgcccccugcaagauccccuucuccacccaggacgagaagggggugacccagaacggccgccucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcauguucaccuccgucgggaagcuggugcaccagguguucggcaccgccuacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcucgagaacaucauguggaagcagaucagcaacgagcugaaccacauccugcucgagaacgacaugaaguucaccgugguggucggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggccuggaacaucugggagguggaggacuacggcuucgggaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcacgaccguggucguggacgagcacugcggcaaccgcgggccgagccuccggaccaccacggugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggauccugugcgccagcaucaugaucgaggaggugaugcggucccgcuggagccggaagaugcucaugaccggcacgcuggccguguuccugcuccugaucaccgggcagcugaccuggaacgaccucauccgccugugcaucauggucggcgcgaacgccuccgaccgcauggggaugggcaccacguaccuggcccucauggccaccuucaagaugcggccgauguucgccguggggcugcuguuccgccggcucaccagccgcgaggugcugcugcucaccaucgggcugucccuggucgcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccgucuccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugcggcugcugaccaagcccugggacgugauccccauggucacccagaucgccaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgcgaucggggccgucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgcggacgacaccgccgggugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgcgaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggccgagcgggugcucgacuggcuggagaagcacggggccgagcgccugaagcggauggccaucuccggcgacgacugcguggucaagcccaucgacgaccgcuucgccaccgcgcucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcgcagauguggcagcucauguacuuccaccggcgcgaccugcggcuggccgccaacgccaucugcuccgcggugcccguggacuggguccccacgagccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggccacgaacauccagguggcgaucaaccagguccggcgccugaucgggaacgagaacuaccuggacuacaugaccuccaugaagcgguucaagaacgagagcgaccccgagggcgcccucugguga

SEQ ID NO: 8152 - RNA, 9879 nt, Artificial Sequence
  derived and/or modified CDS sequence (opt1) from DENV-1__FJ024479__SS-prME
agcgugaccaugcugcucaugcugcugcccaccgcccucgccuuccaccugaccacccggggcggggagccccacaugaucgugagcaagcaggagcggggcaagagccugcuguucaagaccuccgcgggggugaacaugugcacccugaucgccauggaccugggggagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucggguucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgugggccugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccgccgcgauggcccugagcaucgucucccuguucccccucugccugagcaccacgucccagaagaccaccuggcugccggugcuccugggcagcuucgggugcaagccccugaccauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgcgugcuacgugaucagcggguccagcgccgaccucucccuggagaaggccgccgaggucagcugggagcaggaggccgagcacuccggcacgagccacaacauccugguggaggugcaggacgacgggaccaugaagaucaaggacgaggagcgcgacgacacccucaccauccugcugaaggcgacgcuccuggccgucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacaccauguggcacgugacgcgcggggccgugcugauguaccagggcaagcggcuggagcccagcugggcguccgucaagaaggaccucaucagcuacggcgggggcuggcgcuuccagggguccuggaacaccggcgaggagguccaggugaucgccgucgagcccgggaagaacccgaagaacgugcagaccacccccggcacguucaagacccccgagggcgaggugggggccaucgcccuggacuucaagcccggcaccagcggguccccgaucgucaaccgggagggcaagaucgugggccuguacgggaacggcguggucaccacgagcgggaccuacguguccgccaucgcgcaggccaaggccagccaggagggcccccuccccgagaucgaggacgagguguucaagaagcgcaaccugaccaucauggaccugcacccggggagcggcaagacccggcgcuaccuccccgccaucguccgggaggcgaucaagcgcaagcugcggacgcugauccucgcccccacccgcgugguggccuccgagauggccgaggcccugaagggcaugcccauccgcuaccagaccaccgcggucaagagcgagcacacggggcgggagaucguggaccugaugugccacgccaccuucaccaugcgccuccuguccccggugcggguccccaacuacaacaugaucaucauggacgaggcccacuucaccgaccccgccagcaucgccgcgcgcggcuacaucuccacgcggguggggaugggcgaggccgccgccaucuucaugaccgccacgccgcccgggagcguggaggcguucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgccaacugccugcgcaagaacggcaagcgggucauccagcucagccgcaagaccuucgacaccgaguaccagaagaccaagaacaacgacugggacuacguggugacgaccgacaucuccgagaugggggccaacuuccgggcggcccgcgucaucgacccccggcgcugccugaagcccgugauccugaaggacggccccgagcgggugauccucgccgggccgaugcccgucaccguggccagcgccgcgcagcgccggggccgcaucggccggaaccagaacaaggagggggaccaguacguguacaugggccagccccugaacaacgacgaggaccacgcccacuggaccgaggccaagaugcugcucgacaacaucacgacccccgaggggaucaucccggcccuguucgagcccgagcgcgagaaguccgccgcgaucgacggcgagagccgccugcgcggggagccccgcaagaccuucgucgagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggccgaaggagggcgagcgcaagaagcugcggccccgcuggcuggacgcccggaccuacagcgacccccucgcccugggggaguucaaggaguucggcgccggccgccggagcggguccggcgcgcugauccucgagaucgggaagcugccccagcaccucccgcugcgcgcccagaacggccuggacaaccuggucauggugcacaacagcgagcagggcgggaaggccuaccggcacgccauggaggagcuccccgacaccaucgagacgcugaugcugcucgcgcugaucgccgugcugaccggcggggucacccucuucuuccuguccggcaaggggcugggcaagaccagcaucgggcuccugugcgugacggccuccagcgcccugcucuggauggccuccguggagccccacuggaucgcggccagcaucauccuggaguucuuccugaugguccuccugaucccggagcccgaccgccagcggacgccccaggacaaccagcuggccuacguggugaucggccuccuguucaugauccugaccgucgccgccaacgagaugggccuccuggagaccacgaagaaggaccuggggaucggccacguggcggccgagaaccaccagcacgccaccaugcucgacguggaccugcgccccgccuccgccuggacccuguacgcggucgccaccacggugaucaccccgaugaugcggcacaccaucgagaacaccacggccaacaucagccucaccgccaucgccaaccaggcggccauccugauggggcuggccaagggcuggcccaucuccaagauggacaucggggugccccuccuggcccugggcugcuacagccaggucaacccccucacccugaccgcggccgugcugaugcucguggcccacuacgccaucaucggcccggggcugcaggccaaggcgacgcgcgaggcccagaagcggaccgccgccggcaucaugaagaaccccaccgucgacgggaucguggccaucgaccuggaccccguggucuacgacgcgaaguucgagaagcagcucggccagaucaugcugcugauccucuggaccucccagauccugcugaugcgcacgaccugggcccucggcgagagcaucacccuggccaccgggccccugacgacccucugggagggcuccccggggaaguucuggaacaccaccaucgccgugagcauggccaacaucuuccgcggcuccuaccuggcgggggccggccuggccuucagccucaugaagucccugggcgggggccggcgcgggacgggcgcccagggggagacccugggcgagaaguggaagcggcagcucaaccagcugagcaagagcgaguucaacaccuacaagcgcuccggcaucauggagguggaccggagcgaggcgaaggaggggcugaagcgcggcgagaccacgaagcacgccgucucccgggggaccgccaagcuccgcugguucguggagcggaaccuggugaaccccgagggcaaggucaucgaccuggggugcggccgcggcggguggagcuacuacugcgccggccugaagaaggugaccgaggugaagggguacaccaagggcgggcccggccacgaggagcccaucccgauggccaccuacggcuggaaccucgucaagcugcacuccgggaaggacguguucuucaucccgcccgagaagugcgacacgcugcucugcgacaucggcgagagcucccccaacccgaccaucgaggaggggcggacccugcgcggccugaagaugguggagcccuggcuccggggcaaccaguucugcaucaagauccugaaccccuacaugcccagcgucguggagacccuggagcagaugcagcgcaagcacgggggcaugcucgugcggaacccgcugucccgcaacagcacgcacgagauggacugggucuccugcgggaccggcaacaucgugagcgcggugaacaugaccucccggaugcugcucaaccgcuucaccauggcccaccggaagcccacguacgagcgcgacgucgaccugggggccggcacccgccacguggccguggagcccgaggucgccaaccuggacaucaucggccagcggaucgagaacaucaagaacgagcacaagagcaccuggcacuacgacgaggacaaccccuacaagaccugggcguaccacggguccuacgaggugaagccgagcggcuccgccagcuccauggugaacggggucgugcgccuccugacgaagcccugggacgugauccccauggucacccagaucgccaugaccgacaccacgccguucggccagcagcggguguucaaggagaaggucgacacccgcacgccccgggccaagcgcgggaccacgcagaucauggaggugaccgccaaguggcuguggggcuuccucagccggaacaagaagccccgcaucugcacccgggaggaguucacccgcaaggugcggagcaacgcggccaucggcgccgucgugguggacgagaaccaguggaacuccgccaaggaggcgggggaggacgagcgcgucugggaccugggcgaccgggagcgcgagcugcacaagcaggggaagugcgccacgugcggcuacaacaugauggggaagcgggagaagaagcucggcgaguucggcaaggccaaggggagccgcgccaucugguacauguggcugggcgcccgguuccuggaguucgaggcgcucggguucaugaacgaggaccacugguucucccgcgagaacagccuguccggcguggagggcgaggggcugcacaagcucggcuacauccugcgggacaucagcaagauccccgggggcaacauguacgccgacgacaccgccgggugggacacccgcaucaccgaggacgaccugcagaacgaggccaagaucacggacaucauggagccggagcacgcccuccuggcgaccuccaucuucaagcugaccuaccagaacaaggugguccgggugcagcgccccgccaagaacggcaccgugauggacgucaucagccgccgggcccagcgcggcuccggccaggugggcacguacgggcucaacaccuucaccaacauggaggugcagcugauccggcagauggagagcgagggcaucuuccugcccuccgagcucgagacccccaaccuggccgagcgcguccuggacuggcucgagaagcacggggccgagcggcugaagcgcauggcgaucagcggcgacgacugcguggugaagccgaucgacgaccgguucgccacggcccugaccgcccucaacgacaugggcaagguccgcaaggacaucccccagugggagcccuccaagggguggaacgacuggcagcaggucgccuucuggagccaccacuuccaccagcugaucaugaaggacggccgggagaucgugguccccugccgcaaccaggacgagcucggcgggcgggcgcgcgugucccagggggccggguggagccuccgggagaccgccugccugggcaaguccuacgcccagauguggcagcugauguacuuccaccgccgggaccuccgccuggcggccaacgccaucugcagcgccgugccggucgacugggugcccaccagccggaccacgugguccauccacgcccaccaccaguggaugaccaccgaggacaugcugagcguguggaaccgcgucuggaucgaggagaaccccuggauggaggacaagacccacguguccagcugggaggaggugcccuaccucgggaagcgggaggaccaguggugcggcucccugaucgggcugacggcgcgcgccaccugggccaccaacauccaggucgccaucaaccaggugcgccggcucaucggcaacgagaacuaccuggacuacaugaccagcaugaagcgcuucaagaacgaguccgacccggagggggcccugugguga

SEQ ID NO: 8153 - RNA, 9879 nt, Artificial Sequence
  derived and/or modified CDS sequence (opt1) from DENV-1__FJ182002__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggggagcucugcgaggacaccaugaccuacaagugcccccagaucaccgaggccgagcccgacgacguggacugcuggugcaacgccaccgacacgugggugaccuacgggaccugcagccagaccggggagcaccggcgggacaagcgcuccguggcccuggcgccccacgugggccuggggcucgagacgcggaccgagaccuggaugagcuccgagggcgccuggaagcagauccagcgcgucgagaccugggcccugcggcacccgggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucaccgggcagcugaccuggaacgaccucauccgccugugcaucauggugggcgcgaacgccuccgaccgcauggggaugggcacgaccuaccuggcccucauggccaccuucaagaugcggccgauguucgccgugggccugcuguuccgccggcucaccagccgcgagguccugcugcucacgaucgggcugucccugguggcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgucucccuguucccccucugccugagcaccaccucccagaagaccaccuggcugccggugcuccugggcagcuucgggugcaagccccugacgauguuccucaucaccgagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacgcucaccauccugcugaaggccacccuccuggcggucuccggcguguaccccaugagcauccccgccacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagacgacccccggcaccuucaagacccccgagggcgaggugggggccaucgcccuggacuucaagcccggcacgagcggguccccgaucgucaaccgggagggcaagaucgugggccuguacgggaacggcguggucaccaccagcgggaccuacguguccgccaucgcccaggcgaaggccagccaggagggcccccuccccgagaucgaggacgagguguucaagaagcgcaaccugacgaucauggaccugcacccggggagcggcaagacccggcgcuaccuccccgccaucguccgggaggccaucaagcgcaagcugcggacccugauccucgcgcccacccgcgugguggccuccgagauggccgaggcccugaagggcaugcccauccgcuaccagacgaccgccgucaagagcgagcacaccgggcgggagaucguggaccugaugugccacgcgaccuucacgaugcgccuccuguccccggugcggguccccaacuacaacaugaucaucauggacgaggcccacuucaccgaccccgccagcaucgccgcccgcggcuacaucuccacccggguggggaugggcgaggcggccgccaucuucaugaccgccacgcccccggggagcguggaggccuucccccaguccaacgcggucauccaggacgaggagcgcgacauccccgagcggagcuggaacuccggcuacgacuggaucaccgacuuccccggcaagaccgugugguucgugccgagcaucaaguccgggaacgacaucgccaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucacgguggccagcgccgcccagcgccggggccgcaucggccggacccagaccaaggagggggaccaguacguguacaugggccagccccugaacaacgacgaggaccacgcccacuggaccgaggcgaagaugcugcucgccaacaucaacacccccgaggggaucaucccggcccuguucgagcccgagcgcgagaagucccccgccaucgacggcgaguaccgccugcgcggggaggcccgcaagacguucgucgagcucaugcggcgcggcgaccugcccguguggcugagcuacaaggucgcguccgagggcuuccaguacagcgaccggcgcuggugguucgacggggagcggaacaaccaggugcucgaggagaacauggacguggagaucuggaccaaggagggcgagcgcaagaagcugcggccgcgcuggcuggacgcccggaccuacuccgacccccucgcccugggggaguucaaggaguucggcgccggccgccggagcgggagcggcgaccugauccucgagaucgggaagcugccccagcaccugacccuccgcgcccagaacggccuggacaaccuggucauggugcacaacuccgagcagggcgggaaggcguaccggcacgccauggaggagcuccccgacacgaucgagacccugaugcugcucgcccugaucgccgugcugaccggcggggucacccucuucuuccugagcggcaaggggcugggcaagacguccaucgggcuccugugcgugaccgcgagcuccgcccugcucuggauggccagcguggagccgcacuggaucgccgccuccaucauccuggaguucuuccugaugguccuccugauccccgagcccgaccgccagcggaccccgcaggacaaccagcuggcguacguggugaucggccuccuguucaugauccugaccgucgccgccaacgagaugggccuccuggagacgaccaagaaggaccuggggaucggccacguggccgccgagaaccaccagcacgcgaccaugcucgacguggaccugcgccccgccagcgccuggacccuguacgccgucgccacgaccgugaucacccccaugaugcggcacaccaucgagaacacgaccgcgaacaucucccucaccgccaucgccaaccaggccgccauccugauggggcuggacaagggcuggcccaucagcaagauggacaucggggugccgcuccuggcgcugggcugcuacucccaggucaacccccucacccugacggccgccgugcugaugcucguggcccacuacgcgaucaucggccccgggcugcaggccaaggccacccgcgaggcccagaagcggaccgccgcgggcaucaugaagaaccccaccgucgacgggaucguggccaucgaccuggacccgguggucuacgacgccaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgcgguguccauggccaacaucuuccgcgggagcuaccuggccggcgccgggcuggccuucucccucaugaagucccugggcggcgggcggcgcggcaccggggcgcagggcgagacccugggggagaaguggaagcggcagcucaaccagcuguccaagagcgaguucaacaccuacaagcgcagcggcaucauggagguggaccgguccgaggccaaggagggccugaagcgcggggagaccacgaagcacgccgucagccggggcaccgccaagcuccgcugguucguggagcggaaccuggugaagcccgaggggaaggucaucgaccugggcugcgggcgcggcggcugguccuacuacugcgcggggcugaagaaggugaccgaggugaagggcuacaccaagggcgggccggggcacgaggagcccauccccauggccacguacggcuggaaccucgucaagcugcacagcggcaaggacguguucuucaugcccccggagaagugcgacacccugcucugcgacaucggggaguccagccccaaccccaccaucgaggagggccggacccugcgcgugcugaagauggucgagcccuggcuccgggggaaccaguucugcaucaagauccugaacccguacaugcccuccgugguggagacgcuggagcagaugcagcgcaagcacggcggcaugcucguccggaacccccugagccgcaacuccacccacgagauguacugggugagcugcgggaccggcaacaucguguccgccgucaacaugaccagccggaugcugcucaaccgcuucacgauggcccaccggaagcccaccuacgagcgcgacguggaccugggggccggcacccgccacguggcggucgagccggagguggccaaccuggacaucaucgggcagcggaucgagaacaucaagaacgagcacaaguccaccuggcacuacgacgaggacaaccccuacaagacgugggccuaccacggcagcuacgaggugaagcccuccggcagcgccuccagcauggucaacgggguggugcgccuccugaccaagcccugggacgucaucccgauggugacccagaucgccaugaccgacacgacccccuucggccagcagcgggucuucaaggagaagguggacacccgcacgccccgggcgaagcgcgggacgacccagaucauggaggugaccgccaaguggcuguggggcuuccucucccggaacaagaagccgcgcaucugcacccgggaggaguucacgcgcaagguccggagcaacgccgccaucggggccguguucguggacgagaaccaguggaacagcgcgaaggaggccggcgaggacgagcgcgucugggaccugguggaccgggagcgcgagcugcacaagcagggcaagugggggaccggcggguacaacaugaugggcaagcgggagaagaagcucggggaguucggcaaggccaagggcucccgcgggaucugguacauguggcugggcgcccgguuccuggaguucgaggcgcucggguucaugaacgaggaccacugguucagccgcgagaacucccugagcggcguggagggcgaggggcugcacaagcucggcuacauccugcgggacaucuccaagauccccgggggcaacauguacgccgacgacaccgccgggugggacacccgcaucacggaggacgaccugcagaacgaggccaagaucaccgacaucauggagcccgagcacgcccuccuggcgaccagcaucuucaagcugaccuaccagaacaaggucgugcgggugcagcgccccgccaagaacggcacggucauggacgugaucucccgccgggaccagcgcggcagcggccaggugggcaccuacgggcucaacaccuucaccaacauggagguccagcugauccggcagauggaguccgagggcaucuuccugccgagcgagcucgagacccccaaccuggccgagcgcgugcuggacuggcucgagaagcacggggccgagcggcugaagcgcaugcccaucuccggcgacgacugcguggucaagcccaucgacgaccgguucgccacggcgcugaccgcccucaacgacaugggcaaggugcgcaaggacaucccgcagugggagcccagcaagggguggaacgacuggcagcagguccccuucuggucccaccacuuccaccagcugaucaugaaggacggccgggagaucgucgugcccugccgcaaccaggacgagcugguggggcgggcccgcgucagccagggcgccggguggucccuccgggagaccgccuggcugggcaagagcuacgcgcagaugggccagcugauguacuuccaccgccgggaccuccgccuggccgccaacgccaucugguccgccgggccgggcgacugggugcccaccagccggacgaccuggagcauccacgcgcaccaccaguggaugaccaccgaggacaugcuguccguguggaaccgcgucuggaucgaggagaaccccuggauggaggacaagacgcacgugagcuccugggaggaggugcccuaccucgggaagcgggaggaccaguggugcggcagccugaucgggcugaccgcccgcgccaccugggccaccaacauccaggucgcgaucaaccaggugcgccggcucaucggcaacgagaacuaccuggacuacaugacguccaugaagcgcuucaagaacgagagcgacccggagggcgcccugugguga

SEQ ID NO: 8154 - RNA, 9879 nt, Artificial Sequence
  derived and/or modified CDS sequence (opt1) from DENV-1__FJ024482__SS-prME
agcgugaccaugcugcucaugcugcugcccaccgcccucgccuuccaccugaccacccggggcggggagccgcacaugaucgugagcaagcaggagcggggcaagagccuccuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcggguggagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuuccucacccaggacgagaagggggugacgcagaacggccgccugaucaccgccaacccgaucgugaccgacaaggagaagcccgucaacaucgagaccgagccgcccuucggggaguccuacaucguggugggcgccggcgagaaggcgcugaagcucagcugguucaagaagggguccagcaucggcaagauguucgaggccacggcccgcggggcccgccggauggccauccugggcgacaccgcgugggacuucggguccaucggcggcgucuucaccagcguggggaagcuggugcaccaggucuucggcaccgccuacgggguccucuucuccggcgugagcuggacgaugaagaucgggaucggcauccugcugaccuggcucggccugaacucccgcagcaccucccugagcaugaccugcaucgccgucgggauggugacgcucuaccugggcgugaugguccaggccgacuccgggugcgugaucaacuggaagggccgcgagcugaagugcgggagcggcaucuucgugaccaacgagguccacaccuggaccgagcaguacaaguuccaggccgacuccccgaagcggcucagcgcggccaucggcaaggccugggaggagggggugugcggcauccgcagcgccacccggcuggagaacaucauguggaagcagaucuccaacgagcugaaccacauccuccuggagaacgacaugaaguucacgguggucgugggggacgccaacggcauccuggcgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcucaagcugcgcgacagcuacacccagaugugcgaccaccggcugauguccgcggccaucaaggacagcaaggccguccacgccgacaugggcuacuggaucgaguccgagaagaacgagaccuggaagcucgcccgcgcgagcuucaucgaggugaagacgugcaccuggcccaagucccacacccuguggagcaacggcgugcuggaguccgagaugaucauccccaagaucuacgggggcccgaucagccagcacaacuaccggcccggguacuucacccagacggccggccccuggcaccucgggaagcuggagcuggacuucgaccucugcgagggcaccaccgucgugguggacgagcacugcggcaaccgcgggccgucccugcggaccacgaccgucaccggcaagaucauccacgaguggugcugccgcagcugcacccugccgccccuccgguuccgcggggaggacggcugcugguacgggauggagauccggcccgugaaggagaaggaggagaaccuggugcgcuccauggucagcgccggcuccggcgagguggacagcuucagccuggggauccucugcgccuccaucaugaucgaggaggugaugcggagccgcuggucccggaagaugcugaugacgggcacccuggccgucuuccuccugcugaucauggggcagcucaccuggaacgaccugauccgccugugcaucauggugggcgcgaacgccagcgaccgcauggggaugggcaccacguaccucgcccugauggccaccuucaagaugcggccgauguucgccguggggcuccucuuccgccggcugaccucccgcgagguccugcuccugaccaucgggcugagccucguggcguccguggagcugcccaacagccuggaggagcucggcgacgggcuggccaugggcaucaugaugcugaagcuccugacggaguuccagccccaccagcuguggaccacccuccugucccugaccuucaucaagacgacccucagccuggacuacgccuggaagaccaccgccauggcgcuguccaucgucagccucuucccccugugccuguccacgaccagccagaagaccaccuggcucccggugcugcugggcuccuucgggugcaagccccucaccauguuccugaucacggagaacaagaucuggggccgcaagagcuggccccugaacgaggggaucauggccaucggcaucgucuccauccuccugagcucccugcucaagaacgacgugccccuggccgggccgcugaucgccggcggcaugcucaucgccugcuacgugaucagcgggagcuccgcggaccugagccuggagaaggccgccgaggucuccugggagcaggaggccgagcacagcggcaccucccacaacauccucguggaggugcaggacgacgggaccaugaagaucaaggacgaggagcgcgacgacacccugacgauccugcucaaggccacccugcuggcggucagcggcguguaccccauguccauccccgccacccucuucgugugguacuucuggcagaagaagaagcagcggagcgggguccugugggacacccccuccccgcccgagguggagcgcgccgugcuggacgacggcaucuaccggauccugcagcgcggccuccuggggcggagccaggucggcguggggguguuccaggacggcgucuuccacacgauguggcacgugacccgcggggccgugcugauguaccagggcaagcggcucgagcccuccugggccagcgucaagaaggaccugaucuccuacggcgggggcuggcgcuuccaggggagcuggaacaccggcgaggagguccaggugaucgcggucgagcccgggaagaacccgaagaacgugcagaccacgcccggcaccuucaagacccccgagggcgaggugggggccaucgcccuggacuucaagcccggcaccuccgggagcccgaucgucaaccgggagggcaagaucgugggccucuacgggaacggcguggucacgaccuccgggaccuacgugagcgccaucgcccaggcgaaggccucccaggagggcccccugcccgagaucgaggacgagguguucaagaagcgcaaccugaccaucauggaccuccacccggggagcggcaagacgcggcgcuaccugcccgccaucguccgggaggccaucaagcgcaagcugcggacccucauccuggcgcccacccgcgugguggccagcgagauggccgaggcccugaagggcaugcccauccgcuaccagaccacggccgucaaguccgagcacaccgggcgggagaucguggaccucaugugccacgcgaccuucaccaugcgccugcugagcccggugcggguccccaacuacaacaugaucaucauggacgaggcccacuucacggaccccgccuccaucgccgcccgcggcuacaucagcacccggguggggaugggcgaggcggccgccaucuucaugaccgccacgccgcccggguccguggaggccuucccccagagcaacgcggucauccaggacgaggagcgcgacauccccgagcgguccuggaacagcggcuacgacuggaucacggacuuccccggcaagaccgugugguucgugcccuccaucaagagcgggaacgacaucgccaacugccuccgcaagaacggcaagcgggucauccagcugucccgcaagaccuucgacaccgaguaccagaagacgaagaacaacgacugggacuacguggugaccaccgacaucagcgagaugggggccaacuuccgggccgaccgcgucaucgacccccggcgcugccugaagcccgugauccucaaggacggccccgagcgggugauccuggcggggccgaugcccgucaccguggccuccgccgcccagcgccggggccgcaucggccggaaccagaacaaggagggggaccaguacguguacaugggccagccccugaacaacgacgaggaccacgcccacuggacggaggcgaagaugcuccuggacaacaucaacacccccgaggggaucaucccggcccuguucgagcccgagcgcgagaaguccgccgccaucgacggcgaguaccgccuccgcggggaggcccgcaagaccuucgucgagcugaugcggcgcggcgaccugcccguguggcucuccuacaaggucgcgagcgagggcuuccaguacuccgaccggcgcuggugcuucgacggggagcggaacaaccaggugcuggaggagaacauggacguggagaucuggcccaaggagggcgagcgcaagaagcugcggccgcgcuggcucgacgcccggaccuacagcgacccccuggcccugcgcgaguucaaggaguucgccgccgggcggcgcuccgucagcggcgaccucauccuggagaucggcaagcugccccagcaccucacccugcgggcgcagaacgcccuggacaaccucgugauggugcacaacagcgagcagggcgggaaggccuaccgccacgccauggaggagcugcccgacacgaucgagacccugaugcuccuggcgcugaucgccguccucaccgggggcgugacccuguucuuccuguccgggaagggccucggcaagacgagcaucgggcugcugugcgugaccgccuccagcgcccuccuguggauggccuccgucgagccgcacuggaucgcggccagcaucauccuggaguucuuccucauggugcugcugauccccgagcccgaccggcagcgcaccccgcaggacaaccagcucgccuacguggucaucggccugcuguuccucauccugaccguggccgccaacgagauggggcugcucgagacgaccaagaaggaccugggcaucgggcacguggcggccgagaaccaccagcacgccaccaugcuggacgucgaccuccggcccgccuccgccuggacccuguacgcgguggccacgaccgugaucacccccaugaugcgccacaccaucgagaacacgaccgccaacaucagccugaccgccaucgccaaccaggcggccauccucaugggccuggacaagggcuggcccaucuccaagauggacaucggggucccgcugcucgcccugggcugcuacagccaggugaacccccugacccucacggccgcggugcugaugcuggucgcccacuacgccaucaucgggcccggccuccaggccaaggccacccgggaggcgcagaagcgcaccgccgccgggaucaugaagaaccccaccguggacggcaucguggccaucgaccuggacccggucguguacgacacgaaguucgagaagcagcugggccagaucaugcuccugauccugugcaccucccagauccuccugaugcgcaccaccugggcccugugcgagagcaucacgcucgcgaccgggccccugaccacccugugggagggcucccccgggaaguucuggaacacgaccaucgccgugagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucagcaaguccgaguucaacacguacaagcggagcggcaucauggaggucgaccgcagcgaggccaaggaggggcugaagcggggcgagaccaccaagcacgccgugucccgcgggaccgcgaagcugcggugguucguggagcgcaaccuggucaagcccgagggcaaggugaucgaccucggcugcgggcggggcggguggagcuacuacugcgccggccugaagaaggugaccgaggucaagggguacacgaagggcggcccggggcacgaggagcccauccccauggccaccuacggcuggaaccuggugaagcuccacuccgggaaggacguguucuucaugcccccggagaagugcgacacccugcugugcgacaucggcgagagcucccccaaccccaccaucgaggaggggcgcacgcuccggguccugaagaugguggagcccuggcugcgcggcaaccaguucugcaucaagauccucaacccguacaugcccagcguggucgagacccuggagcagaugcagcggaagcacggcgggaugcuggugcgcaacccccucucccggaacagcacccacgagauguacuggguguccugcggcaccgggaacaucgucagcgccgugaacaugacgucccgcaugcugcugaaccgguucaccauggcccaccgcaagcccaccuacgagcgcgacguggaccucggcgcgggcacccggcacgucgccguggagccggagguggccaaccuggacaucaucgggcagcgcaucgagaacaucaagaacgagcacaagagcacguggcacuacgacgaggacaaccccuacaagaccugggccuaccacggcuccuacgaggucaagcccagcggguccgccagcuccauggugaacggcgugguccggcugcucaccaagcccugggacgugaucccgauggucacccagaucgcgaugacggacaccacccccuucgggcagcagcgcguguucaaggagaagguggacacccggacgccccgcgccaagcggggcaccacccagaucauggaggucaccgccaaguggcuguggggcuuccugagccgcaacaagaagccgcggaucugcacgcgcgaggaguucacccggaaggugcgcuccaacgccgccaucggggcgguguucgucgacgagaaccaguggaacagcgccaaggaggccguggaggacgagcgguucugggaccucgugcaccgcgagcgggagcugcacaagcagggcaagugcgcgaccugcgucuacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucucccgggagaacagcuucuccggcguggagggggagggccuccacaagcugggguacauccugcgcgacaucagcaagauccccggcggcaacauguacgccgacgacaccgcggggugggacacgcggaucaccgaggacgaccuccagaacgaggccaagaucaccgacaucauggagcccgagcacgcccugcuggccaccuccaucuucaagcucacguaccagaacaaggugguccgcgugcagcgccccgccaagaacggcaccgugauggacgucaucagccggcgcgcgcagcggggguccggccaggugggcaccuacgggcugaacaccuucacgaacauggaggugcagcugauccgccagauggagagcgagggcaucuuccucccguccgagcuggagacccccaaccuggccgagcggguccucgacuggcuggagaagcacggggccgagcgccugaagcggauggccaucagcggcgacgacugcguggugaagcccaucgacgaccgcuucgccaccgcgcucaccgcccugaacgccauggggaagguccggaaggacaucccccagugggagccguccaagggcuggaacgacuggcagcagguccccuucugcagccaccacuuccaccagcugaucaugaaggacggccgcgagaucgugguccccugccggaaccaggacgagcucguggggcgcgcccgggugucccagggcgccggguggagccugcgcgagaccgcgugccugggcaaguccuacgcccagauguggcagcucauguacuuccaccggcgcgaccugcggcuggccgccaacgcgaucugcagcgccguccccguggacugggugccgacgucccgcaccaccuggagcauccacgcccaccaccaguggaugaccacggaggacaugcucagcgucuggaaccggguguggaucgaggagaaccccuggauggaggacaagacccacguguccagcugggaggagguccccuaccuggggaagcgcgaggaccaguggugcggcucccugaucggccucaccgcccgcgccaccugggcgacgaacauccagguggccaucaaccaggugcggcgccugaucgggaacgagaacuaccuggacuacaugaccagcaugaagcgguucaagaacgaguccgaccccgagggcgcccucugguga

SEQ ID NO: 8155 - RNA, 9879 nt, Artificial Sequence
  derived and/or modified CDS sequence (opt1) from DENV-1__EU596501__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccccugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccugcucccccugugccugagcacgaccucccagaagaccaccuggcucccggugcugcugggcagcuucgggugcaagccccucaccauguuccugaucacggagaacaagaucuggggccggaaguccuggccccugaacgaggggaucauggccaucggcaucgucagcauccuccuguccagccugcucaagaacgacgugccccuggccgggccgcugaucgccggcggcaugcucaucgccugcuacgugaucagcggguccagcgcggaccugucccuggagaaggccgccgaggucagcugggagcaggaggccgagcacuccggcaccagccacaacauccucguggaggugcaggacgacgggaccaugaagaucaaggacgaggagcgcgacgacacccugacgauccugcucaaggccacccugcuggcggucuccggcguguaccccaugagcauccccgccacccucuucgugugguacuucuggcagaagaagaagcagcgguccgggguccugugggacacccccagcccgcccgagguggagcgcgccgugcuggacgacggcaucuaccggaucaugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccuggagggcgaggugggggccaucgcccuggacuucaagcccggcaccagcgggucccccaucgucaaccgggagggcaagaucgugggccucuacgggaacggcguggucacgaccagcgggaccuacguguccgccaucgcccaggcgaaggccagccaggagggcccgcugcccgagaucgaggacgagguguucaagaagcgcaaccugaccaucauggaccuccaccccgggagcggcaagacgcggcgcuaccugccggccaucguccgggaggccaucaagcgcaagcugcggacccucauccuggcgcccacccgcgugguggccuccgagauggccgaggcccugaagggcaugcccauccgcuaccagaccacggccgucaagagcgagcacaccgggcgggagaucguggaccucaugugccacgcgaccuucaccaugcgccugcugucccccgugcgggucccgaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccgcaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccuccgcaagaacggcaagcgggucauccagcugagccgcaagaccuucgacaccgaguaccagaagacgaagaacaacgacugggacuacguggugaccaccgacaucuccgagaugggggccaacuuccgggccgaccgcgucaucgacccgcggcgcugccugaagcccgugauccucaaggacggccccgagcgggugauccuggcggggcccaugccggucaccguggccagcgccgcccagcgccggggccgcaucggccggaaccagaacaaggagggggaccaguacguguacaugggccagccccugaacaacgacgaggaccacgcccacuggacggaggcgaagaugcuccuggacaacaucaacacccccgaggggaucauccccgcccuguucgagccggagcgcgagaaguccgccgccaucgacggcgaguaccgccuccgcggggaggcccgcaagaccuucgucgagcugaugcggcgcggcgaccugcccguguggcucagcuacaaggucgcguccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcccggaccuacuccgacccccuggcccugcgcgaguucaaggaguucgccgccgggcggcgcagcgucagcggcgaccucauccuggagaucggcaagcugccgcagcaccucacgcugcgggcgcagaacgcccuggacaaccucgugaugcugcacaacuccgagcagggcgggaaggccuaccgccacgccauggaggagcugcccgacaccaucgagacccucaugcugcuggcgcucaucgccgugcugaccgggggcgucacgcuguucuuccucagcgggaagggccugggcaagaccuccaucgggcugcucugcgugaccgccagcuccgcccugcuguggauggccagcguggagccccacuggaucgcggccuccaucauccucgaguucuuccugaugguccugcucauccccgagccggaccggcagcgcacgccccaggacaaccagcuggccuacguggugaucggccuccucuucaugauccugacggucgccgccaacgagauggggcugcucgagaccaccaagaaggaccugggcaucgggcacguggcggccgagaaccaccagcacgccaccaugcuggacguggaccuccggcccgccagcgccuggacgcuguacgcggucgccaccaccgugaucaccccgaugaugcgccacacgaucgagaacaccaccgccaacaucucccugaccgccaucgccaaccaggcggccauccucaugggccuggacaagggcuggcccaucagcaagauggacaucggggugccccugcucgcccugggcugcuacucccaggucaacccccugacgcucaccgccgcggugcugaugcugguggcccacuacgccaucaucgggccgggccuccaggccaaggccacccgggaggcgcagaagcgcaccgccgccgggaucaugaagaaccccacggucgacggcaucguggccaucgaccuggaccccguggucuacgacgccaaguucgagaagcagcugggccagaucaugcuccugauccugugcaccagccagauccuccugaugcgcaccaccugggcgcugugcgaguccaucacgcucgccaccgggccccugaccacccugugggagggcagcccggggaaguucuggaacacgaccaucgccguguccauggccaacaucuuccggggcagcuaccucgccggcgcggggcuggccuucucccugaugaagucccucggcgggggccgccgggggaccggcgcccagggcgagacccugggggagaaguggaagcgccagcugaaccagcucuccaagagcgaguucaacacguacaagcggagcggcaucauggagguggaccgcuccgaggccaaggaggggcugaagcggggcgagaccaccaagcacgcggucagccgcgggaccgccaagcugcggugguucguggagcgcaaccuggugaagcccgagggcaaggucaucgaccucggcugcgggcggggcgggugguccuacuacugcgccggccugaagaaggugaccgaggugaagggguacacgaagggcggccccgggcacgaggagcccaucccgauggccaccuacggcuggaaccuggucaagcuccacagcgggaaggacguguucuucaugccgcccgagaagugcgacacccugcugugcgacaucggcgaguccagccccaacccgaccaucgaggaggggcgcacgcuccgggugcugaagauggucgagcccuggcugcgcggcaaccaguucugcaucaagauccucaaccccuacaugcccuccgugguggagacccuggagcagaugcagcggaagcacggcgggaugcugguccgcaacccgcucagccggaacuccagccacgagauguacuggguguccugcggcaccgggaacaucgugagcgccgucaacaugaccucccgcaugcugcugaaccgguucacgauggcgcaccgcaagcccaccuacgagcgcgacguggaccucggcgccggcacccggcacguggccgucgagcccgagguggccaaccuggacaucaucgggcagcgcaucgagaacaucaagaacgagcacaagagcaccuggcacuacgacgaggacaaccccuacaagacgugggccuaccacggcuccuacgaggugaagccgagcggguccgcgagcuccauggucaacggcguggugcggcugcucaccaagcccugggacgucauccccauggugacccagaucgccaugaccgacacgacccccuucgggcagcagcgcgucuucaaggagaagguggacacccggaccccgcgcgccaagcggggcacgacccagaucauggaggugaccgccaaguggcuguggggcuuccugagccgcaacaagaagccccggaucugcacccgcgaggaguucacgcggaagguccgcagcaacgccgcgaucggggccguguucguggacgagaaccaguggaacuccgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcgucgagggggagggccugcacaagcugggguacauccuccgcgacaucagcaagauccccggcggcaacauguacgcggacgacaccgccgggugggacacccggaucacggaggacgaccugcagaacgaggccaagaucaccgacaucauggagccggagcacgcccugcucgccaccuccaucuucaagcugaccuaccagaacaagguggugcgcguccagcgccccgcgaagaacggcacggugauggacgugaucagccggcgcgaccagcggggguccggccaggucggcaccuacgggcugaacaccuucaccaacauggaggugcagcucauccgccagauggagagcgagggcaucuuccugcccuccgagcuggagacgcccaaccucgccgagcgggugcuggacuggcuggagaagcacggggccgagcgccucaagcggauggccaucagcggcgacgacugcgucgugaagccgaucgacgaccgcuucgccaccgcgcugaccgcccugaacgacauggggaaggugcggaaggacaucccccagugggagcccuccaagggcuggaacgacuggcagcagguccccuucugcagccaccacuuccaccagcucaucaugaaggacggccgcgagaucguggugccgugccggaaccaggacgagcuggucgggcgcgcccgggugucccagggcgccggguggagccugcgcgagaccgccugccucggcaaguccuacgcgcagauguggcagcugauguacuuccaccggcgcgaccugcggcucgccgccaacgccaucugcagcgcggugcccgucgacugggugcccaccagccgcacgaccugguccauccacgcccaccaccaguggaugaccaccgaggacaugcugagcguguggaaccgggucuggaucgaggagaaccccuggauggaggacaagacgcacguguccagcugggaggaggugccguaccuggggaagcgcgaggaccaguggugcggcucccucaucggccugaccgcccgcgccaccugggccaccaacauccaggucgcgaucaaccaggugcggcgccugaucgggaacgagaacuaccucgacuacaugacgagcaugaagcgguucaagaacgaguccgaccccgagggcgcccugugguga

SEQ ID NO: 8156 - RNA, 9879 nt, Artificial Sequence
  derived and/or modified CDS sequence (opt1) from DENV-1__FJ898437__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgugaccaugcuggacgucgaccugcggccggccagcgccuggacgcucuacgccguggcgaccaccgugaucacccccaugaugcgccacacgaucgagaacaccaccgccaacaucucccugaccgccaucgccaaccaggccgcgauccugaugggccucgacaagggcuggcccaucagcaagauggacaucggggucccccugcuggcccucggcugcuacucccaggugaacccgcugacgcugaccgccgccgugcucaugcuggucgcgcacuacgccaucaucgggcccggccugcaggccaaggccacccgggaggcccagaagcgcaccgcggccgggaucaugaagaaccccacgguggacggcaucguggccaucgaccucgaccccgucguguacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccguguccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggaggucgaccgcuccgaggccaaggaggggcucaagcggggcgagaccaccaagcacgccgugagccgcgggaccgcgaagcugcggugguucguggagcgcaaccuggucaagcccgagggcaaggugaucgaccugggcugcgggcggggcgggugguccuacuacugcgccggccucaagaaggugaccgaggucaagggguacacgaagggcggccccgggcacgaggagccgauccccauggccaccuacggcuggaaccuggugaagcugcacagcgggaaggacguguucuucaugccgcccgagaagugcgacacccuccugugcgacaucggcgaguccagcccgaaccccaccaucgaggaggggcgcacgcugcggguccucaagaugguggagcccuggcugcgcggcaaccaguucugcaucaagauccugaaccccuacaugccguccguggucgagacccucgagcagaugcagcggaagcacggcgggaugcuggugcgcaacccccugagccggaacuccacccacgagauguacugggugagcugcggcaccgggaacaucgucuccgccgugaacaugacgagccgcaugcuccugaaccgguucaccauggcccaccgcaagcccaccuacgagcgcgacguggaccugggcgcgggcacccggcacgucgccguggagcccgagguggccaaccucgacaucaucgggcagcgcaucgagaacaucaagaacgagcacaaguccacguggcacuacgacgaggacaacccguacaagaccugggccuaccacggcagcuacgaggucaagcccuccgggagcgccuccagcauggugaacggcgugguccggcugcugaccaagcccugggacgugauccccauggucacccagaucgcgaugacggacaccaccccguucgggcagcagcgcguguucaaggagaagguggacacccggacgccccgcgccaagcggggcaccacccagaucauggaggucaccgccaaguggcucuggggcuuccugucccgcaacaagaagccccggaucugcacgcgcgaggaguucacccggaaggugcgcagcaacgccgccaucggggcgguguucaucgacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcgucgagggggagggccuccacaagcugggguacauccugcgcgacaucuccaagaucccgggcggcaacauguacgccgacgacaccgcggggugggacacgcgggugaccgaggacgaccuccagaacgaggccaagaucaccgacaucauggagcccgagcacgcccugcuggccaccagcaucuucaagcucacguaccagaacaaggugguccgcgugcagcgccccgccaagaacggcaccgugauggacgucaucucccggcgcgaccagcgggggagcggccaggugggcaccuacgggcugaacaccuucacgaacauggaggugcagcugauccgccagauggaguccgagggcaucuuccuccccagcgagcuggagaccccgaaccuggcggagcggguccucgacuggcuggagaagcacggggccgagcgccugcggcgcauggccaucuccggcgacgacugcguggugaagcccaucgacgaccgguucgccaccgcccucaccgcgcugaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcucguggggcgggcccgcgugagccagggcgccggguggucccugcgggagaccgccugccugggcaagagcuacgcccagauguggcagcucauguacuuccaccgccgggaccugcgccuggcggccaacgccaucugcuccgccguccccguggacugggugcccacgagccggaccaccuggagcauccacgcgcaccaccaguggaugaccacggaggacaugcucuccgucuggaaccgcguguggaucgaggagaacccguggauggaggacaagacccacgugagcuccugggaggagguccccuaccuggggaagcgcgaggaccaguggugcggcagccugaucggccucaccgcccgggccaccugggccacgaacauccagguggccaucaaccaggugcgccggcugaucgggaacgagaacuaccuggacuacaugaccuccaugaagcgcuucaagaacgagagcgaccccgagggcgcgcucugguga

SEQ ID NO: 8157 - RNA, 9879 nt, Artificial Sequence
  derived and/or modified CDS sequence (opt1) from DENV-1__FJ024480__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugauggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgugucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcgcugugcgaguccaucacgcuggccaccgggccgcucaccacccugugggagggcagccccgggaaguucuggaacacgaccaucgccgucuccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgcggugagccgcgggaccgccaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcaccgggaacaucguguccgccgugaacaugacgagccgcaugcuccugaaccgguucaccauggcgcaccgcaagcccaccuacgagcgcgacgucgaccugggcgccggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgcguccagcauggugaacggcgucgugaagcugcugaccaagcccugggacgugauccccauggucacccagaucgccaugacggacaccaccccguucgggcagcagcggguguucaaggagaaggucgacacccgcacgccccgggccaagcgcggcaccacccagaucauggaggugaccgccaaguggcucuggggcuuccugucccggaacaagaagccccgcaucugcacgcgggaggaguucacccgcaaggugcggagcaacgccgcgaucggggccgucuucguggacgagaaccaguggaacagcgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgcggacgacaccgccgggugggacacgcgcaucaccgaggacgaccuccagaacgaggccaagaucaccgacaucauggagcccgagcacgcccugcuggccaccagcaucuucaagcucacguaccagaacaaggucgugcgggugcagcgccccgcgaagaacggcaccgucauggacgugaucucccgccgggaccagcgcgggagcggccaggugggcaccuacgggcugaacaccuucacgaacauggagguccagcugauccggcagauggaguccgagggcaucuuccuccccagcgagcuggagaccccgaaccuggccgagcgcgugcucgacuggcuggagaagcacggggccgagcggcugaagcgcauggccaucuccggcgacgacugcguggucaagcccaucgacgaccgguucgccaccgcgcucaccgcccugaacgacauggggaaggugcgcaaggacaucccccagugggagcccagcaagggcuggaacgacuggcagcaggucccguucugcucccaccacuuccaccagcugaucaugaaggacggccgggagaucgucgugcccugccgcaaccaggacgagcucguggggcgggcccgcgucagccagggcgccggguggucccugcgggagaccgccugccugggcaagagcuacgcgcagauguggcagcucauguacuuccaccgccgggaccugcgccuggccgccaacgccaucugcuccgcggugcccguggacuggguccccacgagccggaccaccuggagcauccacgcccaccaccaguggaugaccacggaggacaugcucuccguguggaaccgcguguggaucgaggagaacccguggauggaggacaagacccacgucagcuccugggaggaggugcccuaccuggggaagcgggaggaccaguggugcggcagccugaucggccucaccgcccgcgccaccugggccacgaacauccagguggcgaucaaccagguccgccggcugaucgggaacgagaacuaccuggacuacaugaccuccaugaagcgcuucaagaacgagagcgaccccgagggcgcccucugguga

SEQ ID NO: 8158 - RNA, 9879 nt, Artificial Sequence
  derived and/or modified CDS sequence (opt1) from DENV-1__FJ873814__SS-prME
agcgugaccaugcugcucaugcugcugcccaccgcccucgccuuccaccugaccacccggggcggggagccccacaugaucgugagcaagcaggagcggggcaagagccuccucuucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggucaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugguggccuucuuccuggcgcacgccaucggcaccagcaucacccagaaggggaucaucuucauccuccugaugcuggucacccccuccauggccaugcgcugcgugggcaucggcaaccgggacuucguggaggggcucagcggcgccacgugggucgacguggugcuggagcacggguccugcgucaccaccauggccaagaacaagcccacccuggacaucgagcuccugaagacggaggugaccaaccccgcgauccugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaucaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccgccaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccggcugaagauggacaagcugacgcucaagggcaccuccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucgugaucggcgccggcgagaaggcgcucaagcuguccugguucaagaaggggagcuccaucggcaagauguucgaggccaccgcccgcggggcccgccggauggccauccugggcgacacggcgugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccugugguccaacggcgugcucgagagcgagaugaucauccccaagaucuacgggggcccgaucucccagcacaacuaccggcccggguacuucacccagaccgccggccccuggcaccuggggaagcuggagcucgacuucgaccugugcgagggcacgaccgucgugguggacgagcacugcggcaaccgcgggccgagccugcggaccaccacggucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccucgggauccugugcgccagcaucaugaucgaggaggugaugcggucccgcuggagccggaagaugcugaugaccggcacgcucgccgucuuccugcugcucaucauggggcagcugaccuggaacgaccugauccgccucugcaucauggugggcgcgaacgccuccgaccgcauggggaugggcaccaccuaccuggcccugauggccacguucaagaugcggccgauguucgccgugggccuccuguuccgccggcugaccagccgcgagguccuccugcugaccaucgggcucucccugguggcgagcguggagcugcccaacucccucgaggagcugggcgacgggcuggccaugggcaucaugaugcucaagcugcugaccgaguuccagccccaccagcucuggacgacccugcugagccucaccuucaucaagaccacgcugucccuggacuacgccuggaagaccaccgccauggcgcucagcaucgucucccuguucccccugugccucagcaccacgucccagaagaccaccuggcugccggugcugcucggcagcuucgggugcaagccccugaccauguuccugaucaccgagaacaagaucuggggccggaaguccuggccccucaacgaggggaucauggccaucggcaucgucagcauccugcuguccagccuccugaagaacgacgugccccuggccgggccgcucaucgccggcggcaugcugaucgccugcuacgugaucagcggguccagcgcggaccugucccucgagaaggccgccgaggucagcugggagcaggaggccgagcacuccggcacgagccacaacauccugguggaggugcaggacgacgggaccaugaagaucaaggacgaggagaaggacgacacccugaccauccuccugaaggccacgcugcucgcggucuccggcguguaccccaugagcauccccgccacccuguucgugugguacuucuggcagaagaagaagcagcgcuccgggguccugugggacacccccagcccgcccgagguggagcgggccgugcucgacgacggcaucuaccgcauccugcagcggggccugcuggggcgcucccaggucggcguggggguguuccaggacggcgucuuccacaccauguggcacgugacgcgcggggccgugcucauguaccagggcaagcgccuggagcccagcugggccuccgucaagaaggaccugaucagcuacggcgggggcuggcgguuccagggguccuggaacaccggcgaggagguccaggugaucgcggucgagcccgggaagaacccgaagaacgugcagaccacccccggcacguucaagacccccgagggcgaggugggggccaucgcccucgacuucaagcccggcaccagcggguccccgaucgucaaccgcgagggcaagaucgugggccuguacgggaacggcguggucaccacgagcgggaccuacguguccgccaucgcccaggcgaaggccagccaggagggcccccugcccgagaucgaggacgagguguucaagaagcggaaccucaccaucauggaccugcacccggggagcggcaagacccgccgguaccugcccgccaucguccgcgaggccaucaagcggaagcuccgcacgcugauccuggcgcccacccgggugguggccuccgagauggccgaggcccucaagggcaugcccauccgcuaccagaccaccgccgucaagagcgagcacacggggcgcgagaucguggaccugaugugccacgcgaccuucaccaugcggcugcucuccccggugcgcguccccaacuacaacaugaucaucauggacgaggcccacuucaccgaccccgccagcaucgccgcccggggcuacaucuccacgcgcguggggaugggcgaggcggccgccaucuucaugaccgccacgccgcccgggagcguggaggccuucccccaguccaacgcggucauccaggacgaggagcgggacauccccgagcgcagcuggaacuccggcuacgacuggaucaccgacuuccccggcaagacggugugguucgugcccagcaucaaguccgggaacgacaucgccaacugccugcggaagaacggcaagcgcgucauccagcugagccggaagaccuucgacaccgaguaccagaagaccaagaacaacgacugggacuacguggugacgaccgacaucuccgagaugggggccaacuuccgcgccgaccgggucaucgacccccgccggugccucaagcccgugauccugaaggacggccccgagcgcgugauccuggcggggccgaugcccgucaccguggccagcgccgcccagcggcgcggccggaucggccgcaaccagaacaaggagggggaccaguacguguacaugggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugcgcggggaggcccggaagaccuucgucgagcugaugcgccggggcgaccuccccguguggcugagcuacaaggucgcguccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccgcuggcccuccgggaguucaaggaguucgccgccgggcgccggagcgucagcggcgaccugauccuggagaucggcaagcucccccagcaccugacccugcgcgcgcagaacgcccucgacaaccuggugaugcugcacaacuccgagcagggcgggaaggccuaccggcacgccauggaggagcuccccgacacgaucgagacccugaugcugcucgcgcugaucgccgugcugaccgggggcgucacccucuucuuccugagcgggaagggccugggcaagacguccaucgggcuccugugcgugaccgccagcuccgcccugcucuggauggccagcguggagccccacuggaucgcggccuccaucauccuggaguucuuccugaugguccuccugaucccggagcccgaccgccagcggacgccccaggacaaccagcuggccuacguggugaucggccuccuguucaugauccugaccgucgccgccaacgagauggggcuccuggagacgaccaagaaggaccugggcaucgggcacguggcggccgagaaccaccagcacgccaccaugcucgacguggaccugcgcccggccagcgccuggacccuguacgcggucgccacgaccgugaucacccccaugaugcggcacaccaucgagaacacgaccgccaacaucucccucaccgccaucgccaaccaggcggccauccugaugggccuggacaagggcuggcccaucagcaagauggacaucggggugccccuccuggcccugggcugcuacucccaggucaacccgcucacccugacggccgcggugcugaugcucguggcccacuacgccaucaucgggcccggccugcaggccaaggccacccgcgaggcgcagaagcggaccgccgccgggaucaugaagaaccccaccgucgacggcaucguggccaucgaccuggaccccguggucuacgacgccaaguucgagaagcagcucggccagaucaugcugcugauccucugcacgagccagauccugcugaugcgcaccaccugggcgcucugcgaguccaucacccuggccacggggccgcugaccacccucugggagggcagccccgggaaguucuggaacaccacgaucgccguguccauggccaacaucuuccgcggcagcuaccuggccggcgcggggcuggccuucucccucaugaagucccugggcgggggccggcgcgggaccggcgcccagggcgagacccugggggagaaguggaagcggcagcucaaccagcuguccaagagcgaguucaacaccuacaagcgcagcggcaucauggagguggaccgguccgaggccaaggaggggcugaagcgcggcgagacgaccaagcacgcggucagccgggggaccgccaagcuccgcugguucguggagcggaaccuggugaagcccgagggcaaggucaucgaccugggcugcgggcgcggcgggugguccuacuacugcgccggccugaagaaggugaccgaggugaagggguacaccaagggcggccccgggcacgaggagagcaucccgauggccacguacgccuggaaccucgucaagcugcacuccggcaaggacguguucuucaugccgcccgagaagugcgacacccugcucugcgacaucggggagagcucccccaacccgaccaucgaggagggccggacccugcgcgugcugaagauggucgagcccuggcuccgggggaaccaguucugcaucaagauccugaaccccuacaugcccagcgugguggagacgcuggagcagaugcagcgcaagcacggcggcaugcucguccggaacccgcugucccgcaacagcacccacgagauguacuggguguccugcgggaccggcaacaucgugagcgcggucaacaugaccucccggaugcugcucaaccgcuucacgauggcccaccggaagcccaccuacgagcgcgacguggaccugggggccggcacccgccacguggccgucgagcccgagguggccaaccuggacaucaucggccagcggaucgagaacaucaagaacgagcacaagagcaccuggcacuacgacgaggacaaccccuacaagacgugggcguaccacggguccuacgaggugaagccgagcggcuccgccagcuccauggucaacgggguggugcgccuccugaccaagcccugggacgucauccccauggugacccagaucgccaugaccgacacgacccccuucggccagcagcgggucuucaaggagaagguggacacccgcaccccgcgggccaagcgcgggacgacccagaucauggaggugaccgccaaguggcuguggggcuuccucagccggaacaagaagccccgcaucugcacccgggaggaguucacgcgcaagguccggagcaacgcggccaucggcgccguguucguggacgagaaccaguggaacuccgccaaggaggcggucgaggacgagcgcuucugggaccuggugcaccgggagcgcgagcugcacaagcaggggaagugcgcgaccugcguguacaacaugaugggcaagcgggagaagaagcucggggaguucggcaaggccaaggggagccgcgccaucugguacauguggcugggcgcccgguuccuggaguucgaggcgcucggcuucaugaacgaggaccacugguucucccgcgagaacagccuguccggggucgagggcgaggggcugcacaagcucggcuacauccugcgggacaucagcaagauccccgggggcaacauguacgccgacgacaccgccggcugggacacccgcaucacggaggacgaccugcagaacgaggccaagaucaccgacaucauggagccggagcacgcccuccuggcgaccuccaucuucaagcugaccuaccagaacaagguggugcggguccagcgccccgccaagaacgggacggugauggacgugaucagccgccgggaccagcgcggcuccgggcaggucggcaccuacggccucaacaccuucaccaacauggaggugcagcugauccggcagauggagagcgaggggaucuuccugcccuccgagcucgagacgcccaaccuggccaagcgcgugcuggacuggcucgagaagcacggcgccgagcggcugaagcgcauggccaucagcggggacgacugcgucgugaagccgaucgacgaccgguucgcgaccgcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugucccagggggccggcuggagccuccgggagaccgcgugccuggggaaguccuacgcccagauguggcagcugauguacuuccaccgccgggaccuccgccuggccgccaacgcgaucugcagcgccgugcccgucgacugggugcccaccagccggacgaccugguccauccacgcccaccaccaguggaugaccaccgaggacaugcugagcguguggaaccgcgucuggaucgaggagaaccccuggauggaggacaagacgcacguguccagcugggaggaggugccguaccucggcaagcgggaggaccaguggugcgggucccugaucggccugaccgcccgcgccaccugggcgaccaacauccaggucgccaucaaccaggugcgccggcucaucggcaacgagaacuaccuggacuacaugacgagcaugaagcgcuucaagaacgaguccgaccccgagggggcccugugguga

SEQ ID NO: 8159 - RNA, 9879 nt, Artificial Sequence
  derived and/or modified CDS sequence (opt1) from DENV-1__JN819403__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggggagcucugcgaggacaccaugaccuacaagugcccccagaucaccgaggccgagcccgacgacguggacugcuggugcaacgccaccgacaccugggucaccuacgggaccugcagccagaccggggagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccgugggccugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucgucucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgccggcggcaugcugaucgccugcuacgugaucagcggguccagcgcggaccucucccuggagaaggccgccgaggucagcugggagcaggaggccgagcacuccggcaccagccacaacauccugguggaggugcaggacgacgggaccaugaagaucaaggacgaggagcgcgacgacacccucacgauccugcugaaggccacccuccuggcggucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgccaucgcccaggcgaaggccagccaggagggcccccuccccgagaucgaggacgagguguucaagaagcgcaaccugaccaucauggaccugcacccggggagcggcaagacgcggcgcuaccuccccgccaucguccgggaggccaucaagcgcaagcugcggacccugauccucgcgcccacccgcgugguggccuccgagauggccgaggcccugaagggcaugcccauccgcuaccagaccacggccgucaagagcgagcacaccgggcgggagaucguggaccugaugugccacgcgaccuucaccaugcgccuccuguccccggugcggguccccaacuacaacaugaucaucauggacgaggcccacuucacggaccccgccagcaucgccgcccgcggcuacaucuccacccggguggggaugggcgaggcggccgccaucuucaugaccgccacgccgcccgggagcguggaggccuucccccaguccaacgcggucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggccgaccgcgucaucgacccccggcgcugccugaagcccgugauccugaaggacggccccgagcgggugauccucgcggggccgaugcccgucaccguggccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucgucgagcucaugcggcgcggcgaccugcccguguggcugagcuacaaggucgcguccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgucagcggcgaccugauccucgagaucggcaagcugccccagcaccugacgcuccgggcgcagaacgcccuggacaaccuggugaugcuccacaacuccgagcagggcgggaaggccuaccgccacgccauggaggagcugcccgacaccaucgagacccugaugcuccuggcgcugaucgccgugcucaccgggggcgucacgcuguucuuccugagcgggaagggccucggcaagaccuccaucgggcugcugugcgugaccgccagcuccgcccuccuguggauggccagcguggagccccacuggaucgcggccuccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggcggccgagaaccaccagcacgccaccaugcuggacguggaccugcggccggccagcgccuggacgcucuacgcggucgccaccaccgugaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggucaacccgcugacgcugaccgccgcggugcucaugcugguggcccacuacgccaucaucgggcccggccugcaggccaaggccacccgggaggcgcagaagcgcaccgccgccgggaucaugaagaaccccacggucgacggcaucguggccaucgaccucgaccccguggucuacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccguguccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaccuacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgagggcccgauccccauggccaccuacggguggaaccuggucaagcugcacagcggcaaggacguguucuucaugccgcccgagaagugcgacacccuccugugcgacaucggggaguccagcccgaaccccacgaucgaggagggccgcacccugcgggugcucaagauggucgagcccuggcugcgcggcaaccaguucugcaucaagauccugaaccccuacaugccguccgugguggagacccucgagcagaugcagcggaaguacgggggcaugcugguccgcaacccccugagccggaacuccacccacgagauguacugggugagcugcgggacgggcaacaucguguccgccgucaacaugaccagccgcaugcuccugaaccgguucaccauggcccaccgcaagcccaccuacgagcgcgacguggaccugggcgcggggacgcggcacguggccgucgagcccgagguggccaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcugcugaccaagcccugggacgucauccccauggugacgcagaucgcgaugaccgacaccaccccguucggccagcagcgcgucuucaaggagaagguggacacgcggacgccccgggccaagcggggcaccacccagaucauggaggugacggccaaguggcucuggggguuccugucccgcaacaagaagccccggaucugcacccgcgaggaguucacccggaagguccgcagcaacgccgccaucggcgcgguguucguggacgagaaccaguggaacagcgccaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgccgacgacacggcgggcugggacacccggaucaccgaggacgaccuccagaacgaggccaagaucaccgacaucauggagcccgagcacgcccugcuggccacgagcaucuucaagcucaccuaccagaacaagguggugcgcguccagcgccccgccaagaacgggaccgugauggacgugaucucccggcgcgaccagcggggcagcggccaggucgggaccuacggccugaacacguucaccaacauggaggugcagcugauccgccagauggaguccgaggggaucuuccuccccagcgagcuggagaccccgaaccuggcggagcgggugcucgacuggcuggagaagcacggcgccgagcgccugaagcggauggccaucuccggggacgacugcgucgugaagcccaucgacgaccgcuucgccaccgcccucaccgcgcugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagacggccugccugggcaagagcuacgcccagauguggcagcucauguacuuccaccggcgcgaccugcggcuggcggccaacgccaucugcuccgccgugcccgucgacugggugcccaccagccgcaccaccuggagcauccacgcgcaccaccaguggaugacgaccgaggacaugcucuccguguggaaccgggucuggaucgaggagaacccguggauggaggacaagacccacgugagcuccugggaggaggugcccuaccugggcaagcgcgaggaccaguggugcggcagccugaucgggcucaccgcccgcgccacgugggccaccaacauccaggucgccaucaaccaggugcggcgccugaucggcaacgagaacuaccuggacuacaugaccuccaugaagcgguucaagaacgagagcgaccccgagggggcgcucugguga

SEQ ID NO: 8160 - RNA, 9879 nt, Artificial Sequence
  derived and/or modified CDS sequence (opt1) from DENV-1__KF973453__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucaucucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccgucuccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaaguacggcgggaugcuggugcgcaacccccugagccggaacuccacccacgagauguacugggucagcugcggcaccgggaacaucguguccgccgugaacaugacgagccgcaugcuccugaaccgguucaccauggcccaccgcaagcccaccuacgagcgcgacgucgaccugggcgcgggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggugaacggcgucgugcggcugcugaccaagcccugggacgugauccccauggucacccagaucgcgaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgccaucggggcggucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacaccgcggggugggacacgcggaucaccgaggacgaccuccagaacgaggccaagaucaccgacaucauggagcccgagcacgcccugcuggccaccagcaucuucaagcucacguaccagaacaaggucgugcgcgugcagcgccccgccaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagaccccgaaccuggcggagcgggugcucgacuggcuggagaagcacggggccgagcgccugaagcggauggccaucuccggcgacgacugcguggucaagcccaucgacgaccgcuucgccaccgcccucaccgcgcugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcccagauguggcagcucauguacuuccaccggcgcgaccugcggcuggcggccaacgccaucugcuccgccgugcccguggacuggguccccacgagccgcaccaccuggagcauccacgcgcaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgcgccaccugggccacgaacauccagguggccaucaaccagguccggcgccugaucgggaacgagaacuaccuggacuacaugaccuccaugaagcgguucaagaacgagagcgaccccgagggcgcgcucugguga

SEQ ID NO: 8161 - RNA, 9879 nt, Artificial Sequence
  derived and/or modified CDS sequence (opt1) from DENV-1__KF973454__SS-prME
agcgugaccaugcuccucaugcuccugcccaccgcccucgccuuccaccugaccacccggggcggggagccgcacaugaucgugagcaagcacgagcggggcaagagccuccuguucaagaccuccaccggggugaacaugugcacccugaucgccauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgcguggaagcagauccagcggguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccaugaccugcaucgccguggggauggugacgcucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaccuggcccaagagccacacccugugguccaacggcguccuggagagcgagaugaucauccccaagaucuacgggggcccgaucucccagcacaacuaccgccccggguacuucacccagacggccggccccuggcaccucgggaagcuggagcuggacuucgaccucugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagcuucucccuggggauccucugcgucagcaucaugaucgaggaggugaugcgcucccgguggagccgcaagaugcugaugacgggcacccuggccguguuccuccugcugaucauggggcagcucaccuggaacgaccugauccgccugugcaucauggucggcgccaacgcguccgaccggauggggaugggcaccacguaccucgcccugauggccaccuucaagcugcgcccgauguucgccgugggcauccucuuccggcgccugaccagccgggaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuuccccaucugccugagcacgaccucccagaagaccaccuggcugccggugcuccugggcagcuucgggugcaagccccugaccauguaccucaucacggagaacaagaucuggggccgcaaguccuggcccaucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugcggaucaaggacgaggagaaggacgacacccugacgauccuccugaaggccacccugcucgccguguccggcgucuaccccaugagcauccccgcgacccuguucgugugguacuucuggcagaagaagaagcagcgcuccggggugcugugggacacccccagcccgcccgaggucgagcgggccgugcucgacgacggcaucuaccgcauccugcagcggggccugcuggggcgcucccaggugggcgucgggguguuccaggacggcguguuccacacgauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccugcccgagaucgaggacgagguguucaagaagcggaaccucaccaucauggaccugcacccggggagcggcaagacgcgccgguaccugcccgccaucgugcgcgaggccaucaagcggaagcuccgcacccugauccuggcccccacccgcgucguggcguccgagauggccgaggcccucaagggcaugcccauccgguaccagaccacggccgucaagagcgagcacaccgggcgcgagaucgucgaccugaugugccacgccaccuucaccaugcggcugcucuccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcugagccggaagaccuucgacaccgaguaccagaagacgaagaacaacgacugggacuacgucgugaccaccgacaucuccgagaugggggccaacuuccgcgccgaccgggugaucgacccccgccggugccucaagcccgucauccugaaggacggccccgagcgcgugauccuggccgggccgaugcccgugaccgucgcgagcgccgcccagcggcgcggccggaucggccgcaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcgcgcaccuacuccgacccgcuggcccuccgggaguucaaggaguucgccgccgggcgccggagcgugagcggcgaccugauccuggagaucggcaagcucccccagcaccugacgcugcgcgcccaguccgcgcucgacaaccuggucaugcugcacaacagcgagcagggcgggaaggccuaccggcacgccauggaggagcuccccgacaccaucgagacccugaugcugcucgcccugaucgcggugcugaccgggggcgugaugcuguucuuccuguccgggaagggccugggcaagacgagcaucgggcuccugugcgucaccgccuccagcgcccugcucuggauggccuccguggagccccacuggaucgccgcgagcaucauccuggaguucuuccugauggugcuccugaucccggagcccgaccgccagcggacgccccaggacaaccagcuggccuacgucgugaucggccuccuguucaugauccugaccguggccgccaacgagauggggcuccuggagacgaccaagcgcgaccugggcaucgggcacgucgccgcggagaaccaccagcacgccaccaugcucgacguggaccugcggccggccuccgccuggacccuguacgccguggcgacgaccgucaucacccccaugaugcgccacaccaucgagaacacgaccgccaacaucagccucaccgccaucgccaaccaggccgcgauccugaugggccuggacaagggcuggcccaucuccaagauggacaucggggugccccuccuggcccugggcugcuacagccaggugaacccgcucacccugacggccgccguccugaugcucguggcgcacuacgccaucaucgggcccggccugcaggccaaggccacccgcgaggcccagaagcggaccgcggccgggaucaugaagaaccccaccguggacggcaucgucgccaucgaccuggaccccgugguguacgacgccaaguucgagaagcagcucggccagaucaugcugcugauccucugcacgucccagauccugcugaugcgcaccaccugggcccucugcgagagcaucacccuggcgacggggccgcugaccacccucugggagggcucccccgggaaguucuggaacaccacgaucgccgucagcauggccaacaucuuccggggcuccuaccuggccggcgccgggcuggcguucagccucaugaagucccugggcgggggccgccgggggaccggcgcccagggcgagacccugggggagaaguggaagcgccagcucaaccagcugagcaagcccgaguucaacaccuacaagcggagcggcaucauggagguggaccgcuccgaggccaaggaggggcugaagcggggcgagacgaccaagcacgccgugagccgcgggaccgcgaagcuccggugguucgucgagcgcaaccuggugaagcccgagggcaaggugaucgaccugggcugcgggcggggcgggugguccuacuacugcgccggccugaagaaggucaccgaggugaagggguacaccaagggcggcccggggcacgaggagcccauccccauggccacguacggcuggaaccucgugaagcugcacagcgggaaggacgucuucuucaugcccccggagaagugcgacacccugcucugcgacaucggcgaguccagccccaaccccaccaucgaggaggggcgcacccugcgggugcugaagaugguggagcccuggcuccgcggcaaccaguucugcaucaagauccugaacccguacaugcccuccgucguggagacgcuggagcagaugcagcggaagcacggcgggaugcucgugcgcaacccccugagccggaacuccacccacgagauguacugggucagcugcggcaccgggaacaucguguccgccgugaacaugaccagccgcaugcugcucaaccgcuucacgauggcccaccggaagcccaccuacgagcgcgacgucgaccugggcgcgggcacccggcacgugaccguggagccggaggucgccaaccuggacaucaucgggcagcgcaucgagaacaucaagaacgagcacaaguccacguggcacuacgacgaggacaaccccuacaagaccugggccuaccacggcagcuacgaggugaagcccuccgggagcgccuccagcauggugaacggcgucgugcggcuccugaccaagcccugggacgucaucccgauggugacccagaucgccaugacggacaccacccccuucgggcagcagcgcguguucaaggagaaggucgacacccggacgccccgcgcgaagcggggcaccacccagaucauggaggugaccgccaaguggcuguggggcuuccucucccgcaacaagaagccgcggaucugcacgcgcgaggaguucacccggaaggugcgcagcaacgccgccaucggggccgucuucguggacgagaaccaguggaacagcgcgaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcucccgggcgaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagauccccggcggcaacauguacgccgacgacaccgccgggugggacacgcgcaucaccgaggacgaccugcagaacgaggcgaagaucaccgacaucauggagcccgagcacgcccuccuggccaccagcaucuucaagcugacguaccagaacaaggucgugcgggugcagcgccccgccaagaacggcaccgucauggacgugaucucccggcgcgaccagcgggggagcggccaggugggcaccuacgggcucaacaccuucacgaacauggagguccagcugauccgccagauggaguccgagggcaucuuccugccgagcgagcucgagacccccaaccuggccgagcgggugcuggacuggcucgagaagcacggggcggagcgccugaagcggauggccaucuccggcgacgacugcguggucaagcccaucgacgaccgcuucgccaccgcccugaccgcccucaacgacauggggaaggugcggaaggacaucccccagugggagccgagcaagggcuggaacgacuggcagcagguccccuucugcucccaccacuuccaccagcugaucaugaaggacggccgcgagaucgucgugcccugccggaaccaggacgagcugguggggcgcgcgcgggucagccagggcgccggguggucccuccgcgagaccgccugccugggcaagagcuacgcccagauguggcagcugauguacuuccaccggcgcgaccuccggcuggccgcgaacgccaucugcuccgccgugcccguggacugggucccgacgagccgcaccaccuggagcauccacgcccaccaccaguggaugaccacggaggacaugcuguccguguggaaccgcguguggaucgaggagaaccccuggauggaggacaagacccacgucagcuccugggaggaggugcccuaccucgggaagcgggaggaccaguggugcggcagccugaucggccugaccgcgcgcgccaccugggccacgaacauccagguggccaucaaccagguccggcgccucaucgggaacgagaacuaccuggacuacaugaccuccaugaagcgguucaagaacgagagcgaccccgagggcgugcugugguga

SEQ ID NO: 8162 - RNA, 9879 nt, Artificial Sequence
  derived and/or modified CDS sequence (opt1) from DENV-1__KF973455__SS-prME
agcgugaccaugcuccucaugcuccugcccaccgcccucgccuuccaccugaccacccggggcggggagccgcacaugaucgugagcaagcacgagcggggcaagagccuccuguucaagaccagcaccggggugaacaugugcacccugaucgccauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgcguggaagcagauccagcggguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccaugaccugcaucgccguggggauggugacgcucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaccuggcccaagagccacacccugugguccaacggcguccuggagagcgagaugaucauccccaagaucuacgggggcccgaucucccagcacaacuaccgccccggguacuucacccagacggccggccccuggcaccucgggaagcuggagcuggacuucgaccucugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagcuucucccuggggauccucugcgucagcaucaugaucgaggaggugaugcgcucccgguggagccgcaagaugcugaugacgggcacccuggccguguuccuccugcugaucauggggcagcucaccuggaacgaccugauccgccugugcaucauggucggcgccaacgcguccgaccggauggggaugggcaccacguaccucgcccugauggccaccuucaagcugcgcccgauguucgccgugggcauccucuuccggcgccugaccagccgggaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuuccccaucugccugagcacgaccucccagaagaccaccuggcugccggugcuccugggcagcuucgggugcaagccccugaccauguaccucaucacggagaacaagaucuggggccgcaaguccuggcccaucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugcggaucaaggacgaggagaaggacgacacccugacgauccuccugaaggccacccugcucgccguguccggcgucuaccccaugagcauccccgcgacccuguucgugugguacuucuggcagaagaagaagcagcgcuccggggugcugugggacacccccagcccgcccgaggucgagcgggccgugcucgacgacggcaucuaccgcauccugcagcggggccugcuggggcgcucccaggugggcgucgggguguuccaggacggcguguuccacacgauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccugcccgagaucgaggacgagguguucaagaagcggaaccucaccaucauggaccugcacccggggagcggcaagacgcgccgguaccugcccgccaucgugcgcgaggccaucaagcggaagcuccgcacccugauccuggcccccacccgcgucguggcguccgagauggccgaggcccucaagggcaugcccauccgguaccagaccacggccgucaagagcgagcacaccgggcgcgagaucgucgaccugaugugccacgccaccuucaccaugcggcugcucuccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcugagccggaagaccuucgacaccgaguaccagaagacgaagaacaacgacugggacuacgucgugaccaccgacaucuccgagaugggggccaacuuccgcgccgaccgggugaucgacccccgccggugccucaagcccgucauccugaaggacggccccgagcgcgugauccuggccgggccgaugcccgugaccgucgcgagcgccgcccagcggcgcggccggaucggccgcaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcgcgcaccuacuccgacccgcuggcccuccgggaguucaaggaguucgccgccgggcgccggagcgugagcggcgaccugauccuggagaucggcaagcucccccagcaccugacgcugcgcgcccagaacgcgcucgacaaccuggucaugcugcacaacuccgagcagggcgggaaggccuaccggcacgccauggaggagcuccccgacaccaucgagacccugaugcugcucgcccugaucgcggugcugaccgggggcgugaugcuguucuuccugagcgggaagggccugggcaagacguccaucgggcuccugugcgucaccgccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucggccuccuguucaugauccugaccguggccgccaacgagauggggcuccuggagacgaccaagcgcgaccugggcaucgggcacgucgccgcggagaaccaccagcacgccaccaugcucgacguggaccugcacccggccagcgccuggacccuguacgccguggcgacgaccgucaucacccccaugaugcggcacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggugaacccgcucacccugacggccgccguccugaugcucguggcgcacuacgccaucaucgggcccggccugcaggccaaggccacccgcgaggcccagaagcgcaccgcggccgggaucaugaagaaccccaccguggacggcaucgucgccaucgaccuggaccccgugguguacgacgccaaguucgagaagcagcucggccagaucaugcugcugauccucugcacgagccagauccugcugaugcggaccaccugggcccucugcgaguccaucacccuggcgacggggccgcugaccacccucugggagggcagccccgggaaguucuggaacaccacgaucgccgucuccauggccaacaucuuccgcggcagcuaccuggccggcgccgggcuggcguucucccucaugaagucccugggcgggggccggcgcgggaccggcgcccagggcgagacccugggggagaaguggaagcggcagcucaaccagcuguccaagcccgaguucaacaccuacaagcgcagcggcaucauggagguggaccggagcgaggccaaggaggggcugaagcgcggcgagacgaccaagcacgccgugucccgggggaccgcgaagcuccgcugguucgucgagcggaaccuggugaagcccgagggcaaggugaucgaccugggcugcgggcgcggcggguggagcuacuacugcgccggccugaagaaggucaccgaggugaagggguacaccaagggcggcccggggcacgaggagcccauccccauggccacguacggcuggaaccucgugaagcugcacuccgggaaggacgucuucuucaugcccccggagaagugcgacacccugcucugcgacaucggcgagagcucccccaaccccaccaucgaggaggggcggacccugcgcgugcugaagaugguggagcccuggcuccggggcaaccaguucugcaucaagauccugaacccguacaugcccagcgucguggagacgcuggagcagaugcagcgcaagcacggcgggaugcucgugcggaacccccugucccgcaacagcacccacgagauguacugggucuccugcggcaccgggaacaucgugagcgccgugaacaugaccucccggaugcugcucaaccgcuucacgauggcccaccgcaagcccaccuacgagcgggacgucgaccugggcgcgggcacccgccacgugaccguggagccggaggucgccaaccuggacaucaucgggcagcggaucgagaacaucaagaacgagcacaagagcacguggcacuacgacgaggacaaccccuacaagaccugggccuaccacggcuccuacgaggugaagcccagcggguccgccagcuccauggugaacggcgucgugcgccuccugaccaagcccugggacgucaucccgauggugacccagaucgccaugacggacaccacccccuucgggcagcagcggguguucaaggagaaggucgacacccgcacgccccgggcgaagcgcggcaccacccagaucauggaggugaccgccaaguggcuguggggcuuccucagccggaacaagaagccgcgcaucugcacgcgggaggaguucacccgcaaggugcgguccaacgccgccaucggggccgucuucguggacgagaaccaguggaacagcgcgaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacaccgccgggugggacacgcgcaucaccgaggacgaccugcagaacgaggcgaagaucaccgacaucauggagcccgagcacgcccuccuggccaccuccaucuucaagcugacguaccagaacaaggucgugcgcgugcagcggcccgccaagaacggcaccgucauggacgugaucagccgccgggaccagcgcggguccggccaggugggcaccuacgggcucaacaccuucacgaacauggagguccagcugauccggcagauggagagcgagggcaucuuccugccguccgagcucgagacccccaaccuggccgagcgcgugcuggacuggcucgagaagcacggggcggagcggcugaagcgcauggccaucagcggcgacgacugcguggucaagcccaucgacgaccgguucgccaccgcccugaccgcccucaacgacauggggaaggugcgcaaggacaucccccagugggagccguccaagggcuggaacgacuggcagcagguccccuucugcagccaccacuuccaccagcugaucaugaaggacggccgggagaucgucgugcccugccgcaaccaggacgagcugguggggcgggcgcgcgucucccagggcgccggguggagccuccgggagaccgccugccugggcaaguccuacgcccagauguggcagcugauguacuuccaccgccgggaccuccgccuggccgcgaacgccaucugcagcgccgugcccguggacugggucccgacgucccggaccaccuggagcauccacgcccaccaccaguggaugaccacggaggacaugcugagcguguggaaccgcguguggaucgaggagaaccccuggauggaggacaagacccacgucuccagcugggaggaggugcccuaccucgggaagcgcgaggaccaguggugcggcucccugaucggccugaccgcgcgggccaccugggccacgaacauccagguggccaucaaccagguccgccggcucaucgggaacgagaacuaccuggacuacaugaccagcaugaagcgcuucaagaacgaguccgaccccgagggcgcccugugguga

SEQ ID NO: 8163 - RNA, 9879 nt, Artificial Sequence
  derived and/or modified CDS sequence (opt1) from DENV-1__KF973456__SS-prME
agcgugaccaugcuccucaugcuccugcccaccgcccucgccuuccaccugaccacccggggcggggagccgcacaugaucgugagcaagcacgagcggggcaagagccuccuguucaagaccagcaccggggugaacaugugcacccugaucgccauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgcguggaagcagauccagcggguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccaugaccugcaucgccguggggauggugacgcucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaccuggcccaagagccacacccugugguccaacggcguccuggagagcgagaugaucauccccaagaucuacgggggcccgaucucccagcacaacuaccgccccggguacuucacccagacggccggccccuggcaccucgggaagcuggagcuggacuucgaccucugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagcuucucccuggggauccucugcgucagcaucaugaucgaggaggugaugcgcucccgguggagccgcaagaugcugaugacgggcacccuggccguguuccuccugcugaucauggggcagcucaccuggaacgaccugauccgccugugcaucauggucggcgccaacgcguccgaccggauggggaugggcaccacguaccucgcccugauggccaccuucaagcugcgcccgauguucgccgugggcauccucuuccggcgccugaccagccgggaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuuccccaucugccugagcacgaccucccagaagaccaccuggcugccggugcuccugggcagcuucgggugcaagccccugaccauguaccucaucacggagaacaagaucuggggccgcaaguccuggcccaucaacgaggggaucauggcgaucggcaucgugagcauccugcuguccagccuccugaagaacgacgucccccuggccgggccgcucaucgccggcggcaugcugaucgccugcuacgugaucagcggguccagcgccgaccugucccucgagaaggcggccgaggugagcugggagcaggaggccgagcacuccggcaccagccacaacauccuggucgaggugcaggacgacgggaccaugcggaucaaggacgaggagaaggacgacacccugacgauccuccugaaggccacccugcucgccguguccggcgucuaccccaugagcauccccgcgacccuguucgugugguacuucuggcagaagaagaagcagcgcuccggggugcugugggacacccccagcccgcccgaggucgagcgggccgugcucgacgacggcaucuaccgcauccugcagcggggccugcuggggcgcucccaggugggcgucgggguguuccaggacggcguguuccacacgauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccucgacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccugcccgagaucgaggacgagguguucaagaagcggaaccucaccaucauggaccugcacccggggagcggcaagacgcgccgguaccugcccgccaucgugcgcgaggccaucaagcggaagcuccgcacccugauccuggcccccacccgcgucguggcguccgagauggccgaggcccucaagggcaugcccauccgguaccagaccacggccgucaagagcgagcacaccgggcgcgagaucgucgaccugaugugccacgccaccuucaccaugcggcugcucuccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcugagccggaagaccuucgacaccgaguaccagaagacgaagaacaacgacugggacuacgucgugaccaccgacaucuccgagaugggggccaacuuccgcgccgaccgggugaucgacccccgccggugccucaagcccgucauccugaaggacggccccgagcgcgugauccuggccgggccgaugcccgugaccgucgcgagcgccgcccagcggcgcggccggaucggccgcaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcgcgcaccuacuccgacccgcuggcccuccgggaguucaaggaguucgccgccgggcgccggagcgugagcggcgaccugauccuggagaucggcaagcucccccagcaccugacgcugcgcgcccagaacgcgcucgacaaccuggucaugcugcacaacuccgagcagggcgggaaggccuaccggcacgccauggaggagcuccccgacaccaucgagacccugaugcugcucgcccugaucgcggugcugaccgggggcgugaugcuguucuuccugagcgggaagggccugggcaagacguccaucgggcuccugugcgucaccgccagcuccgcccugcucuggauggccagcguggagccccacuggaucgccgcguccaucauccuggaguucuuccugauggugcuccugaucccggagcccgaccgccagcggacgccccaggacaaccagcuggccuacgucgugaucggccuccuguucaugauccugaccguggccgccaacgagauggggcuccuggagacgaccaagcgcgaccugggcaucgggcacgucgccgcggagaaccaccagcacgccaccaugcucgacguggaccugcggccggccagcgccuggacccuguacgccguggcgacgaccgucaucacccccaugaugcgccacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggugaacccgcucacccugacggccgccguccugaugcucguggcgcacuacgccaucaucgggcccggccugcaggccaaggccacccgcgaggcccagaagcggaccgcggccgggaucaugaagaaccccaccguggacggcaucgucgccaucgaccuggaccccgugguguacgacgccaaguucgagaagcagcucggccagaucaugcugcugauccucugcacgagccagauccugcugaugcgcaccaccugggcccucugcgaguccaucacccuggcgacggggccgcugaccacccucugggagggcagccccgggaaguucuggaacaccacgaucgccgucuccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagcccgaguucaacaccuacaagcggagcggcaucauggagguggaccgcagcgaggccaaggaggggcugaagcggggcgagacgaccaagcacgccgugucccgcgggaccgcgaagcuccggugguucgucgagcgcaaccuggugaagcccgagggcaaggugaucgaccugggcugcgggcggggcggguggagcuacuacugcgccggccugaagaaggucaccgaggugaagggguacaccaagggcggcccggggcacgaggagcccauccccauggccacguacggcuggaaccucgugaagcugcacuccgggaaggacgucuucuucaugcccccggagaagugcgacacccugcucugcgacaucggcgagagcucccccaaccccaccaucgaggaggggcgcacccugcgggugcugaagaugguggagcccuggcuccgcggcaaccaguucugcaucaagauccugaacccguacaugcccagcgucguggagacgcuggagcagaugcagcggaagcacggcgggaugcucgugcgcaacccccugucccggaacagcacccacgagauguacugggucuccugcggcaccgggaacaucgugagcgccgugaacaugaccucccgcaugcugcucaaccgcuucacgauggcccaccggaagcccaccuacgagcgcgacgucgaccugggcgcgggcacccggcacgugaccguggagccggaggucgccaaccuggacaucaucgggcagcgcaucgagaacaucaagaacgagcacaagagcacguggcacuacgacgaggacaaccccuacaagaccugggccuaccacggcuccuacgaggugaagcccagcggguccgccagcuccauggugaacggcgucgugcggcuccugaccaagcccugggacgucaucccgauggugacccagaucgccaugacggacaccacccccuucgggcagcagcgcguguucaaggagaaggucgacacccggacgccccgcgcgaagcggggcaccacccagaucauggaggugaccgccaaguggcuguggggcuuccucagccgcaacaagaagccgcggaucugcacgcgcgaggaguucacccggaaggugcgcuccaacgccgccaucggggccgucuucguggacgagaaccaguggaacagcgcgaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggcgaucugguacauguggcugggcgcccgcuuccuggaguucgaggcccucggguucaugaacgaggaccacugguucucccgggagaacagccuguccggcguggagggggagggccugcacaagcucggguacauccugcgcgacaucagcaagauccccggcggcaacauguacgccgacgacaccgccgggugggacacgcgcaucaccgaggacgaccugcagaacgaggcgaagaucaccgacaucauggagcccgagcacgcccuccuggccaccuccaucuucaagcugacguaccagaacaaggucgugcgggugcagcgccccgccaagaacggcaccgucauggacgugaucagccggcgcgaccagcggggguccggccaggugggcaccuacgggcucaacaccuucacgaacauggagguccagcugauccgccagauggagagcgagggcaucuuccugccguccgagcucgagacccccaaccuggccgagcgggugcuggacuggcucgagaagcacggggcggagcgccugaagcggauggccaucagcggcgacgacugcguggucaagcccaucgacgaccgcuucgccaccgcccugaccgcccucaacgacauggggaaggugcggaaggacaucccccagugggagccguccaagggcuggaacgacuggcagcagguccccuucugcagccaccacuuccaccagcugaucaugaaggacggccgcgagaucgucgugcccugccggaaccaggacgagcugguggggcgcgcgcgggucucccagggcgccggguggagccuccgcgagaccgccugccugggcaaguccuacgcccagauguggcagcugauguacuuccaccggcgcgaccuccggcuggccgcgaacgccaucugcagcgccgugcccguggacugggucccgacgucccgcaccaccuggagcauccacgcccaccaccaguggaugaccacggaggacaugcugagcguguggaaccgcguguggaucgaggagaaccccuggauggaggacaagacccacgucuccagcugggaggaggugcccuaccucgggaagcgggaggaccaguggugcggcucccugaucggccugaccgcgcgcgccaccugggccacgaacauccagguggccaucaaccagguccggcgccucaucgggaacgagaacuaccuggacuacaugaccagcaugaagcgguucaagaacgaguccgaccccgagggcgcccugugguga

SEQ ID NO: 8164 - RNA, 9879 nt, Artificial Sequence
  derived and/or modified CDS sequence (opt1) from DENV-1__KF973459__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacccugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccucgggcuggagacgcggaccgagaccuggaugagcuccgagggcgccuggaagcagauccagcgcguggagaccugggcccugcggcaccccggguucacggugaucgcccucuuccuggcgcacgccaucggcaccagcaucacccagaaggggaucaucuucauccugcucaugcuggugacccccuccauggccaugcgcugcgugggcaucggcaaccgggacuucguggaggggcugagcggcgccacguggguggacgucgugcucgagcacggguccugcgugaccaccauggccaagaacaagcccacccuggacaucgagcugcucaagacggaggucaccaaccccgcgauccugcgcaagcugugcaucgaggccaagaucagcaacaccaccacggacucccggugcccgacccagggcgaggccacccucguggaggagcaggacgccaacuucgugugccgccggaccuucgucgaccgcggcugggggaacggcugcgggcuguucggcaaggggagccugcucacgugcgccaaguucaagugcgugaccaagcuggagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcucaccgacuacggggcccugacccuggacugcagcccccggaccggccucgacuucaacgagauggugcugcugacgaugaaggagaaguccuggcucguccacaagcagugguuccuggaccugccgcuccccuggaccuccggggccagcaccagccaggagaccuggaaccgccaggaccugcuggugacguucaagaccgcccacgcgaagaagcaggagguggucgugcucggcucccaggagggcgccaugcacaccgcccugaccggggccacggagauccagaccagcggcaccaccacgaucuucgccgggcaccugaagugccggcucaagauggacaagcugacccugaagggcaccuccuacgugaugugcaccgggagcuucaagcuggagaaggaggucgcggagacgcagcacggcaccgugcucgugcaggucaaguacgagggcaccgacgcccccugcaagauccccuucuccacccaggacgagaagggggugacgcagaacggccgccugaucaccgccaacccgaucgugaccgacaaggagaagcccgucaacaucgagaccgagccgcccuucggggagagcuacaucguggugggcgccggcgagaaggcgcugaagcucuccugguucaagaaggggagcuccaucggcaagauguucgaggccacggcccgcggggcccgccggauggccauccugggcgacaccgcgugggacuucgggagcaucggcggcgucuucaccuccguggggaagcuggugcaccaggucuucggcaccgccuacgggguccucuucagcggcguguccuggacgaugaagaucgggaucggcauccugcugaccuggcucggccugaacagccgcuccaccagccuguccaugaccugcaucgccgucgggauggugacgcucuaccugggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcucagcgcggccaucggcaaggccugggaggagggggugugcggcauccgcuccgccacccggcuggagaacaucauguggaagcagaucagcaacgagcugaaccacauccuccuggagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcucaagcugcgcgacuccuacacccaggucugcgaccaccggcugaugagcgcggccaucaaggacuccaaggccgugcacgccgacaugggcuacuggaucgagagcgagaagaacgagaccuggaagcucgcccgcgcguccuucaucgaggugaagacgugcaccuggcccaagagccacacccugugguccaacggcguccuggagagcgagaugaucauccccaagaucuacgggggcccgaucucccagcacaacuaccggcccggguacuucacccagacggccggccccuggcaccucgggaagcuggagcuggacuucgaccucugcgagggcaccaccgugguggucgacgagcacugcggcaaccgcgggccgagccugcggaccacgaccgugaccggcaagaucauccacgaguggugcugccgcuccugcacccugccgccccuccgguuccgcggggaggacggcugcugguacgggauggagauccggcccgugaaggagaaggaggagaaccugguccgcagcaugguguccgccggcagcggcgagguggacagccugucccucgggauccugugcgccagcaucaugaucgaggaggucaugcggucccgcuggagccggaagaugcugaugacgggcacccucgccguguuccugcugcucaucauggggcagcugaccuggaacgaccugauccgccucugcaucauggugggcgcgaacgccuccgaccgcauggggaugggcaccacguaccuggcccugauggccaccuucaagaugcggccgauguucgccgucggccuccuguuccgccggcugaccagccgcgaggugcuccugcugaccaucgggcucucccugguggcgagcgucgagcugcccaacucccucgaggagcugggcgacgggcuggccaugggcaucaugaugcucaagcugcugacggaguuccagccccaccagcucuggaccacccugcugagccucaccuucaucaagacgacccugucccuggacuacgccuggaagaccaccgccauggcgcucagcaucaucucccuguucccccugugccucagcacgaccucccagaagaccaccuggcugccggugcugcucggcagcuucgggugcaagccccugaccauguuccugaucacggagaacaagaucuggggccggaaguccuggccccucaacgaggggaucauggccaucggcaucgucagcauccugcuguccagccuccugaagaacgacgugccccuggccgggccgcucaucgccggcggcaugcugaucgccugcuacgugaucagcggguccagcgcggaccugucccucgagaaggccgccgaggucagcugggagcaggaggccgagcacuccggcaccagccacaacauccugguggaggugcaggacgacgggaccaugaagaucaaggacgaggagcgcgacgacacccugacgauccuccugaaggccacccugcucgcggucuccggcguguaccccaugagcauccccgccacccuguucgugugguacuucuggcagaagaagaagcagcgguccgggguccugugggacacccccagcccgcccgagguggagcgcgccgugcuggacgacggcaucuaccggauccuccagcgcggccugcuggggcggucccaggucggcguggggguguuccaggacggcgucuuccacacgauguggcacgugacccgcggggccgugcucauguaccagggcaagcggcuggagcccagcugggccuccgucaagaaggaccugaucagcuacggcgggggcuggcgcuuccagggguccuggaacaccggcgaggagguccaggugaucgcggucgagcccgggaagaacccgaagaacgugcagaccacgcccggcaccuucaagacccccgagggcgaggugggggccaucgcccucgacuucaagcccggcaccagcggguccccgaucgucaaccgggagggcaagaucgugggccuguacgggaacggcguggucacgaccagcgggaccuacguguccgccaucgcccaggcgaaggugagccaggagggcccccugcccgagaucgaggacgaggucuucaagaagcgcaaccucaccaucauggaccugcacccggggagcggcaagacgcggcgcuaccugcccgccaucgugcgggaggccaucaagcgcaagcuccggacccugauccuggcccccacccgcguggucgcguccgagauggccgaggcccucaagggcaugcccauccgcuaccagaccacggccgucaagagcgagcacaccgggcgggagaucguggaccugaugugccacgccaccuucaccaugcgccugcucuccccgguccgggugcccaacuacaacaugaucaucauggacgaggcgcacuucacggaccccgccagcaucgccgcccgcggcuacaucuccacccggguggggaugggcgaggccgcggccaucuucaugaccgccacgccgcccgggagcgucgaggccuucccccaguccaacgccgugauccaggacgaggagcgcgacauccccgagcggagcuggaacuccggcuacgacuggaucacggacuuccccggcaagaccgugugguucguccccagcaucaaguccgggaacgacaucgcgaacugccugcgcaagaacggcaagcgggugauccagcugagccgcaagaccuucgacaccgaguaccagaagacgaagaacaacgacugggacuacguggucaccaccgacaucuccgagaugggggccaacuuccgggccgaccgcgugaucgacccccggcgcugccucaagcccgugauccugaaggacggccccgagcgggucauccuggccgggccgaugcccgugaccguggcgagcgccgcccagcgccggggccgcaucggccggaaccagaacaaggagggggaccaguacgucuacaugggccagccccucaacaacgacgaggaccacgcccacuggacggaggccaagaugcugcuggacaacaucaacacccccgaggggaucaucccggcccucuucgagcccgagcgcgagaaguccgcggccaucgacggcgaguaccgccugcgcggggaggcccgcaagaccuucguggagcugaugcggcgcggcgaccuccccgucuggcugagcuacaagguggccuccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcgcggaccuacuccgacccgcuggcccuccgcgaguucaaggaguucgccgccgggcggcgcagcgugagcggcgaccugauccuggagaucggcaagcucccccagcaccugacgcugcgggcccagaacgcgcucgacaaccuggugaugcugcacaacuccgagcagggcgggaaggccuaccgccacgccauggaggagcuccccgacaccaucgagacccugaugcugcucgcccugaucgcgguccugaccgggggcgugacccucuucuuccugagcgggaagggccugggcaagaccuccaucgggcuccugugcgugaccgccagcuccgcccugcucuggauggccagcgucgagccccacuggaucgccgcguccaucauccuggaguucuuccugauggugcuccugaucccggagcccgaccggcagcgcacgccccaggacaaccagcuggccuacguggucaucggccuccuguucaugauccugacgguggccgccaacgagauggggcuccuggagaccaccaagaaggaccugggcaucgggcacguggccgcggagaaccaccagcacgccaccaugcucgacgucgaccugcggccggccagcgccuggacgcuguacgccguggcgaccaccgugaucacccccaugaugcgccacacgaucgagaacaccaccgccaacaucucccucaccgccaucgccaaccaggccgcgauccugaugggccuggacaagggcuggcccaucagcaagauggacaucggggucccccuccuggcccugggcugcuacucccaggugaacccgcucacgcugaccgccgccgugcugaugcucgucgcgcacuacgccaucaucgggcccggccugcaggccaaggccacccgggaggcccagaagcgcaccgcggccgggaucaugaagaaccccacgguggacggcaucguggccaucgaccuggaccccgucguguacgacaccaaguucgagaagcagcucggccagaucaugcugcugauccucugcaccagccagauccugcugaugcgcaccacgugggcccucugcgaguccaucacccuggccaccgggccgcugaccacgcucugggagggcagccccgggaaguucuggaacaccaccaucgcgguguccauggccaacaucuuccggggcagcuaccuggccggcgccgggcuggccuucucccucaugaagucccugggcgggggccgccgggggaccggcgcgcagggcgagacgcugggggagaaguggaagcgccagcucaaccagcuguccaagagcgaguucaacaucuacaagcggagcggcaucauggaggucgaccgcuccgaggccaaggaggggcugaagcggggcgagaccaccaagcacgccgugagccgcgggaccgccaagcugcggugguucguggagcgcaaccucgucaagcccgagggcaaggugaucgaccugggcugcgggcggggcgggugguccuacuacugcgcgggccugaagaaggugaccgaggucaagggguacacgaagggcggccccgggcacgaggagccgauccccauggccaccuacggcuggaaccucgugaagcugcacagcgggaaggacguguucuucaugccgcccgagaagugcgacacccugcucugcgacaucggcgaguccagcccgaaccccaccaucgaggaggggcgcacgcugcggguccugaagaugguggagcccuggcuccgcggcaaccaguucugcaucaagauccugaaccccuacaugccguccguggucgagacccuggagcagaugcagcggaaguacggcgggaugcucgugcgcaacccccugagccggaacuccacccacgagauguacugggugagcugcggcaccgggaacaucgucuccgccgugaacaugacgagccgcaugcugcucaaccgguucaccauggcccaccgcaagcccaccuacgagcgcgacguggaccugggcgccggcacccggcacgucgcgguggagcccgagguggccaaccuggacaucaucgggcagcgcaucgagaacaucaagaacgagcacaaguccacguggcacuacgacgaggacaacccguacaagaccugggccuaccacggcagcuacgaggucaagcccuccgggagcgccuccagcauggugaacggcgugguccggcuccugaccaagcccugggacgugauccccauggucacccagaucgccaugacggacaccaccccguucgggcagcagcgcguguucaaggagaagguggacacccggacgccccgcgcgaagcggggcaccacccagaucauggaggucaccgccaaguggcuguggggcuuccucucccgcaacaagaagccccggaucugcacgcgcgaggaguucacccggaaggugcgcagcaacgccgccaucggggccguguucgucgacgagaaccaguggaacagcgcgaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcucccgggcgaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgccgacgacaccgccgggugggacacgcggaucaccgaggacgaccugcagaacgaggcgaagaucaccgacaucauggagcccgagcacgcccuccuggccaccagcaucuucaagcugacguaccagaacaaggugguccgcgugcagcgccccgccaagaacggcaccgugauggacgucaucucccggcgcgaccagcgggggagcggccaggugggcaccuacgggcucaacaccuucacgaacauggaggugcagcugauccgccagauggaguccgagggcaucuuccugcccagcgagcucgagaccccgaaccuggccaagcggguccuggacuggcucgagaagcacggggcggagcgccugaagcggauggccaucuccggcgacgacugcguggugaagcccaucgacgaccgcuucgccaccgcccugaccgcccucaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcugguggggcgcgcgcgggugagccagggcgccggguggucccuccgcgagaccgccugccugggcaagagcuacgcccagauguggcagcugauguacuuccaccggcgcgaccuccggcuggccgcgaacgccaucugcuccgccguccccguggacugggugcccacgagccgcaccaccuggagcauccacgcccaccaccaguggaugaccacggaggacaugcuguccgucuggaaccggguguggaucgaggagaacccguggauggaggacaagacccacgugagcuccugggaggagguccccuaccucgggaagcgcgaggaccaguggugcggcagccugaucggccugaccgcgcgcgccaccugggccacgaacauccagguggccaucaaccaggugcggcgccucaucgggaacgagaacuaccuggacuacaugaccuccaugaagcgguucaagaacgagagcgaccccgagggcgcccugugguga

SEQ ID NO: 8165 - RNA, 9879 nt, Artificial Sequence
  derived and/or modified CDS sequence (opt1) from DENV-1__KF973460__SS-prME
agcgugaccaugcuccucaugcugcugcccaccgcccucgccuuccaccugaccacccgcggcggggagccgcacaugaucgugagcaagcacgagcggggcaagagccuccuguucaagaccagcaccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcggguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccaugaccugcaucgccguggggauggugacgcucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaccuggcccaagagccacacccugugguccaacggcguccuggagagcgagaugaucauccccaagaucuacgggggcccgaucucccagcacaacuaccgccccggguacuucacccagacggccggccccuggcaccucgggaagcuggagcuggacuucgaccucugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagccugucccucgggauccugugcgucagcaucaugaucgaggaggugaugcgcucccgguggagccgcaagaugcugaugacgggcacccucgccguguuccugcugcucaucauggggcagcugaccuggaacgaccugauccgccucugcaucauggucggcgccaacgcguccgaccggauggggaugggcaccacguaccuggcccugauggccaccuucaagcuccgcccgauguucgccgugggcauccuguuccggcgccugaccagccgggaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccauggcccucagcaucgucucccuguucccccugugccucagcacgaccucccagaagaccaccuggcugccggugcugcucggcagcuucgggugcaagccccugaccauguacuucaucacggagaacaagaucuggggccgcaaguccuggcccaucaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugcggaucaaggacgaggagaaggacgacacccucacgauccugcugaaggccacccuccuggccguguccggcgucuaccccaugagcauccccgcgacccuguucgugugguacuucuggcagaagaagaagcagcgcuccggggugcucugggacacccccagcccgcccgaggucgagcgggccgugcuggacgacggcaucuaccgcauccugcagcggggccugcucgggcgcucccaggugggcgucgggguguuccaggacggcguguuccacacgauguggcacgucacccgcggggccgugcugauguaccagggcaagcgccuggagcccagcugggccuccgugaagaaggaccucaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccuccccgagaucgaggacgagguguucaagaagcggaaccugaccaucauggaccugcacccggggagcggcaagacgcgccgguaccuccccgccaucgugcgcgaggccaucaagcggaagcugcgcacccugauccucgcccccacccgcgucguggcguccgagauggccgaggcccugaagggcaugcccauccgguaccagaccacggccgucaagagcgagcacaccgggcgcgagaucgucgaccugaugugccacgccaccuucaccaugcggcuccuguccccggugcgcgugcccaacuacaacaugaucaucauggacgaggcgcacuucacggaccccgccagcaucgccgcccggggcuacaucuccacccgcgucgggaugggcgaggccgcggccaucuucaugaccgccacgccgcccgggagcguggaggccuucccccaguccaacgccgugauccaggacgaggagcgggacauccccgagcgcagcuggaacuccggcuacgacuggaucacggacuuccccggcaagaccgucugguucgugcccagcaucaaguccgggaacgacaucgcgaacugccugcggaagaacggcaagcgcgugauccagcucagccggaagaccuucgacaccgaguaccagaagacgaagaacaacgacugggacuacgucgugaccaccgacaucuccgagaugggggccaacuuccgcgccgaccgggugaucgacccccgccggugccugaagcccgucauccugaaggacggccccgagcgcgugauccucgccgggccgaugcccgugaccgucgcgagcgccgcccagcggcgcggccggaucggccgcaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcgcgcaccuacuccgacccgcucgcccugcgggaguucaaggaguucgccgccgggcgccggagcgugagcggcgaccugauccucgagaucggcaagcugccccagcaccugacgcuccgcgcccagaacgcgcuggacaaccuggucaugcuccacaacuccgagcagggcgggaaggccuaccggcacgccauggaggagcugcccgacaccaucgagacccugaugcuccuggcccugaucgcggugcucaccgggggcgugacgcuguucuuccugagcgggaagggccucggcaagaccuccaucgggcugcugugcgucaccgccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucggccugcuguucaugauccucacgguggccgccaacgagauggggcugcuggagaccaccaagcgcgaccucggcaucgggcacgucgccgcggagaaccaccagcacgccaccaugcuggacguggaccugcggccggccagcgccuggacgcucuacgccguggcgaccaccgucaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggugaacccgcugacgcugaccgccgccguccucaugcugguggcgcacuacgccaucaucgggcccggccugcaggccaaggccacccgcgaggcccagaagcggaccgcggccgggaucaugaagaaccccacgguggacggcaucgucgccaucgaccucgaccccgugguguacgacgccaaguucgagaagcagcugggccagaucaugcugcucauccugugcaucagccagauccugcucaugcgcaccaccugggcccugugcgaguccaucacccuggcgacggggccgcucaccacccugugggagggcagccccgggaaguucuggaacaccacgaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagcccgaguucaacaccuacaagcggagcggcaucauggagguggaccgcagcgaggccaaggaggggcucaagcggggcgagacgaccaagcacgccgugucccgcgggaccgcgaagcugcggugguucgucgagcgcaaccuggugaagcccgagggcaaggugaucgaccugggcugcgggcggggcggguggagcuacuacugcgccggccucaagaaggucaccgaggugaagggguacaccaagggcggcccggggcacgaggagcccauccccauggccacguacggcuggaaccuggugaagcugcacuccgggaaggacgucuucuucaugcccccggagaagugcgacacccuccugugcgacaucggcgagagcucccccaaccccaccaucgaggaggggcgcacccugcgggugcucaagaugguggagcccuggcugcgcggcaaccaguucugcaucaagauccugaacccguacaugcccagcgucguggagacgcucgagcagaugcagcggaagcacggcgggaugcuggugcgcaacccccugucccggaacagcacccacgagauguacugggucuccugcggcaccgggaacaucgugagcgccgugaacaugaccucccgcaugcuccugaaccgcuucacgauggcccaccggaagcccaccuacgagcgcgacgucgaccugggcgcgggcacccggcacguggccguggagccggaggucgccaaccucgacaucaucgggcagcgcaucgagaacaucaagaacgagcacaagagcaccuggcacuacgacgaggacaaccccuacaagacgugggccuaccacggcuccuacgaggugaagcccagcggguccgccagcuccauggugaacggcgucgugcggcugcugaccaagcccugggacgucaucccgauggugacccagaucgcgaugaccgacacgacccccuucgggcagcagcgcguguucaaggagaaggucgacacccggacgccccgggccaagcggggcacgacccagaucauggaggugaccgccaaguggcucuggggcuuccugagccgcaacaagaagccgcggaucugcacccgcgaggaguucacgcggaaggugcgcuccaacgccgccaucggggcggucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgccgacgacaccgcggggugggacacccgcaucacggaggacgaccuccagaacgaggccaagaucaccgacaucauggagcccgagcacgcccugcuggccaccuccaucuucaagcucaccuaccagaacaaggucgugcgggugcagcgccccgccaagaacggcacggucauggacgugaucagccggcgcgaccagcggggguccggccaggugggcaccuacgggcugaacaccuucaccaacauggagguccagcugauccgccagauggagagcgagggcaucuuccucccguccgagcuggagacgcccaaccuggcggagcgggugcucgacuggcuggagaagcacggggccgagcgccugaagcggauggccaucagcggcgacgacugcguggucaagcccaucgacgaccgcuucgccaccgcccucaccgcgcugaacgacauggggaaggugcggaaggacaucccccagugggagccguccaagggcuggaacgacuggcagcagguccccuucugcagccaccacuuccaccagcugaucaugaaggacggccgcgagaucgucgugcccugccggaaccaggacgagcucguggggcgcgcccgggucucccagggcgccggguggagccugcgcgagaccgccugccugggcaaguccuacgcccagauguggcagcucauguacuuccaccggcgcgaccugcggcuggcggccaacgccaucugcagcgccgugcccguggacugggucccgaccucccgcacgaccuggagcauccacgcgcaccaccaguggaugaccaccgaggacaugcucagcguguggaaccgcguguggaucgaggagaaccccuggauggaggacaagacgcacgucuccagcugggaggaggugcccuaccuggggaagcgggaggaccaguggugcggcucccugaucggccucaccgcccgcgccaccugggccaccaacauccagguggccaucaaccagguccggcgccugaucgggaacgagagcuaccuggacuacaugacguccaugaagcgguucaagaacgagagcgaccccgagggcgcgcucugguga

SEQ ID NO: 8166 - RNA, 9879 nt, Artificial Sequence
  derived and/or modified CDS sequence (opt1) from DENV-1__KF973461__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaugggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgagcugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaucaccgccauggcgcugagcaucaucucccuguucccccucugccugagcaccacgucccagaagaccaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcacgagccacaacauccuggucgaggugcaggacgacgggaccaugaagaucaaggacgaggagcgcgacgacacccucaccauccugcugaaggccacgcuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacaccauguggcacgucacgcgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacccccggcacguucaagacccccgagggcgaggugggggccaucgcccuggacuucaagcccggcaccagcggguccccgaucgugaaccgggagggcaagaucgucggccuguacgggaacggcguggugaccacgagcgggaccuacgucuccgccaucgcccaggcgaaggccagccaggagggcccccuccccgagaucgaggacgagguguucaagaagcgcaaccugaccaucauggaccugcacccggggagcggcaagacccggcgcuaccuccccgccaucgugcgggaggccaucaagcgcaagcugcggacgcugauccucgcgcccacccgcgucguggccuccgagauggccgaggcccugaagggcaugcccauccgcuaccagaccaccgccgucaagagcgagcacacggggcgggagaucgucgaccugaugugccacgcgaccuucaccaugcgccuccuguccccggugcgggugcccaacuacaacaugaucaucauggacgaggcccacuucaccgaccccgccagcaucgccgcccgcggcuacaucuccacgcgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucaccgacuuccccggcaagacggucugguucgugcccagcaucaaguccgggaacgacaucgccaacugccugcgcaagaacggcaagcgggugauccagcucagccgcaagaccuucgacaccgaguaccagaagaccaagaacaacgacugggacuacgucgugacgaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggucaugcuccacaacuccgagcagggcgggaaggccuaccgccacgccauggaggagcugcccgacacgaucgagacccugaugcuccuggcgcugaucgccgugcucaccgggggcgugacccuguucuuccugagcgggaagggccucggcaagacguccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagacgaccaagaaggaccucggcaucgggcacgucgcggccgagaaccaccagcacgccaccaugcuggacguggaccugcggccggccagcgccuggacccucuacgcgguggccacgaccgucaucacccccaugaugcgccacaccaucgagaacacgaccgccaacaucucccugaccgccaucgccaaccaggcggccauccugaugggccucgacaagggcuggcccaucagcaagauggacaucggggugccccugcuggcccucggcugcuacucccaggugaacccgcugacccugacggccgcgguccucaugcugguggcccacuacgccaucaucgggcccggccugcaggccaaggccacccgggaggcgcagaagcgcaccgccgccgggaucaugaagaaccccaccguggacggcaucgucgccaucgaccucgaccccgugguguacgacacgaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacaucuacaagcggagcggcaucauggagguggaccgcuccgaggccaaggaggggcucaagcggggcgagacgaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacaccaagggcggccccgggcacgaggagccgauccccauggccacguacggcuggaaccuggugaagcugcacagcgggaaggacgucuucuucaugccgcccgagaagugcgacacccuccugugcgacaucggcgaguccagcccgaaccccaccaucgaggaggggcgcacccugcgggugcucaagaugguggagcccuggcugcgcggcaaccaguucugcaucaagauccugaaccccuacaugccguccgucguggagacgcucgagcagaugcagcggaaguacggcgggaugcuggugcgcaacccccugagccggaacuccacccacgagauguacugggucagcugcggcaccgggaacaucguguccgccgugaacaugaccagccgcaugcuccugaaccgguucacgauggcccaccgcaagcccaccuacgagcgcgacgucgaccugggcgcgggcacccggcacguggccguggagcccgaggucgccaaccucgacaucaucgggcagcgcaucgagaacaucaagaacgagcacaaguccaccuggcacuacgacgaggacaacccguacaagacgugggccuaccacggcagcuacgaggugaagcccuccgggagcgccuccagcauggugaacggcgucgugcggcugcugaccaagcccugggacgugauccccauggucacccagaucgcgaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgccaucggggcggucuucguggacgagaaccaguggaacagcgccaaggaggccguggaggacgagcgguucugggaccugguccgccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgccgacgacaccgcggggugggacacccgcaucacggaggacgaccuccagaacgaggccaagaucaccgacaucauggagcccgagcacgcccugcuggccaccagcaucuucaagcucaccuaccagaacaaggucgugcgcgugcagcggcccgccaagaacggcacggucauggacgugaucucccgccgggaccagcgcgggagcggccaggugggcaccuacgggcugaacaccuucaccaacauggagguccagcugauccggcagauggaguccgagggcaucuuccuccccagcgagcuggagacgccgaaccuggcggagcgcgugcucgacuggcuggagaagcacggggccgagcggcugaagcgcauggccaucuccggcgacgacugcguggucaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucgucgugcccugccgcaaccaggacgagcucguggggcgggcccgcgucagccagggcgccggguggucccugcgggagaccgccugccugggcaagagcuacgcccagauguggcagcucauguacuuccaccgccgggaccugcgccuggcggccaacgccaucugcuccgccgugcccguggacuggguccccaccagccggacgaccuggagcauccacgcgcaccaccaguggaugaccaccgaggacaugcucuccguguggaaccgcguguggaucgaggagaacccguggauggaggacaagacgcacgucagcuccugggaggaggugcccuaccuggggaagcgcgaggaccaguggugcggcagccugaucggccucaccgcccgggccaccugggccaccaacauccagguggccaucaaccagguccgccggcugaucgggaacgagaacuaccuggacuacaugacguccaugaagcgcuucaagaacgagagcgaccccgagggcgcgcucugguga

SEQ ID NO: 8167 - RNA, 9879 nt, Artificial Sequence
  derived and/or modified CDS sequence (opt1) from DENV-1__KF973462__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacccugaccuacaagugcccccagaucaucgaggccgagcccgacgacguggacugcuggugcaacgccaccgacaccugggugaccuacgggaccugcagccagaccggcgagcaccggcgggacaagcgcuccguggcccuggcgccccacgugggccucgggcuggagacccggaccgagaccuggaugagcuccgagggcgccuggaagcagauccagcgcgucgagaccugggcccugcggcaccccggguucaccgugaucgcccucuuccuggcgcacgccaucggcacgagcaucacccagaaggggaucaucuucauccugcucaugcuggugacccccuccauggccaugcgcugcgucggcaucggcaaccgggacuucguggaggggcugagcggcgccaccuggguggacgucgugcucgagcacggguccugcgugacgaccauggccaagaacaagcccacccuggacaucgagcugcucaagaccgaggucacgaaccccgcgauccugcgcaagcugugcaucgaggccaagaucagcaacaccaccaccgacucccggugcccgacgcagggcgaggccacccucguggaggagcaggacgccaacuucgugugccgccggaccuucgucgaccgcggcugggggaacggcugcgggcuguucggcaaggggagccugcugaccugcgccaaguucaagugcgugacgaagcuggagggcaagaucgugcaguacgagaaccugaaguacuccgucaucgugaccgugcacaccggcgaccagcaccaggucgggaacgagaccacggagcacggcaccaucgcgaccaucacgccccaggcccccaccagcgagauccagcucacggacuacggggcccugacccuggacugcagcccccggaccggccucgacuucaacgagauggugcugcugaccaugaaggagaaguccuggcucguccacaagcagugguuccuggaccugccgcuccccuggacguccggggccagcaccagccaggagaccuggaaccgccaggaccugcuggugaccuucaagacggcccacgcgaagaagcaggagguggucgugcucggcucccaggagggcgccaugcacaccgcccugaccggggccaccgagauccagacgagcggcaccaccaccaucuucgccgggcaccugaagugccggcucaagauggacaagcugacgcugaagggcaccuccuacgugaugugcaccgggagcuucaagcuggagaaggagauggcggagacccagcacggcacgguccucguccaggugaaguacgagggcaccgacgcccccugcaagauccccuucuccacccaggacgagaagggggucacccagaacggccgccugaucacggccaacccgaucgugaccgacaaggagaagcccgugaacaucgagaccgagccgcccuucggggagagcuacaucgucgugggcgccggcgagaaggcgcugaagcucuccugguucaagaaggggagcuccaucggcaagauguucgaggccaccgcccgcggggcccgccggauggccauccugggcgacacggcgugggacuucgggagcaucggcggcguguucaccuccgucgggaagcuggugcaccagguguucggcaccgccuacgggguccucuucagcggcguguccuggaccaugaagaucgggaucggcauccugcugacguggcucggccugaacagccgcuccaccagccuguccaugaccugcaucgccguggggauggucacccucuaccugggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcucagcgcggccaucggcaaggccugggaggagggggucugcggcauccgcuccgccacccggcuggagaacaucauguggaagcagaucagcaacgagcugaaccacauccuccuggagaacgacaugaaguucaccgugguggucggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacaaccagcgggccuggaacaucugggagguggaggacuacggcuucgggaucuucaccacgaacaucuggcucaagcugcgcgacuccuacacccaggugugcgaccaccggcugaugagcgcggccaucaaggacuccaaggccguccacgccgacaugggcuacuggaucgagagcgagaagaacgagaccuggaagcucgcccgcgcguccuucaucgaggugaagaccugcacguggcccaagagccacacccugugguccaacggcgugcuggagagcgagaugaucauccccaagaucuacgggggcccgaucucccagcacaacuaccggcccggguacuucacccagaccgccggccccuggcaccucgggaagcuggagcuggacuucgaccucugcgagggcacgaccgucgugguggacgagcacugcggcaaccgcgggccgagccugcggaccaccacggucaccggcaagaucauccacgaguggugcugccgcuccugcacccugccgccccugcgguuccgcggggaggacggcugcugguacgggauggagauccggcccgugaaggagaaggaggagaaccuggugcgcagcauggucuccgccggcagcggcgagguggacagcuucucccuggggauccucugcgccagcaucaugaucgaggaggugaugcggucccgcuggagccggaagaugcugaugaccggcacgcuggccgucuuccuccugcugaucauggggcagcucaccuggaacgaccugauccgccugugcaucauggugggcgcgaacgccuccgaccgcauggggaugggcaccaccuaccucgcccugauggccacguucaagaugcggccgauguucgccgugggccuccucuuccgccggcugaccagccgcgagguccugcuccugaccaucgggcugucccucguggcgagcguggagcugcccaacucccuggaggagcucggcgacgggcuggccaugggcaucaugaugcugaagcuccugaccgaguuccagccccaccagcuguggacgacccuccugagccugaccuucaucaagaccacgcucucccuggacuacgccuggaagaccaccgccauggcgcugagcaucaucucccucuucccccugugccugagcaccacgucccagaagaccaccuggcucccgguccugcugggcagcuucgggugcaagccccucaccauguuccugaucaccgagaacaagaucuggggccggaaguccuggccccugaacgaggggaucauggccaucggcaucgugagcauccuccuguccagccugcucaagaacgacgucccccuggccgggccgcugaucgccggcggcaugcucaucgccugcuacgugaucagcggguccagcgcggaccugucccuggagaaggccgccgaggugagcugggagcaggaggccgagcacuccggcacgagccacaacauccucgucgaggugcaggacgacgggaccaugaagaucaaggacgaggagcgcgacgacacccugaccauccugcucaaggccacgcugcuggcgguguccggcgucuaccccaugagcauccccgccacccucuucgugugguacuucuggcagaagaagaagcagcgguccggggugcugugggacacccccagcccgcccgaggucgagcgcgccgugcuggacgacggcaucuaccggauccugcagcgcggccuccuggggcggucccaggugggcgucgggguguuccaggacggcguguuccacaccauguggcacgucacgcgcggggccgugcugauguaccagggcaagcggcucgagcccagcugggccuccgugaagaaggaccugaucagcuacggcgggggcuggcgcuuccagggguccuggaacaccggcgaggagguccaggugaucgcgguggagcccgggaagaacccgaagaacguccagaccacccccggcacguucaagacccccgagggcgaggugggggccaucgcccuggacuucaagcccggcaccagcggguccccgaucgugaaccgggagggcaagaucgucggccucuacgggaacggcguggugaccacgagcgggaccuacgucuccgccaucgcccaggcgaaggugagccaggagggcccccugcccgagaucgaggacgagguguucaagaagcgcaaccugaccaucauggaccuccacccggggagcggcaagacccggcgcuaccugcccgccaucguccgggaggccaucaagcgcaagcugcggacgcucauccuggcccccacccgcgugguggcguccgagauggccgaggcccugaagggcaugcccauccgcuaccagaccaccgccgucaagagcgagcacacggggcgggagaucguggaccucaugugccacgccaccuucaccaugcgccugcuguccccggugcggguccccaacuacaacaugaucaucauggacgaggcgcacuucaccgaccccgccagcaucgccgcccgcggcuacaucuccacgcggguggggaugggcgaggccgcggccaucuucaugaccgccacgccgcccgggagcguggaggccuucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgcgaacugccuccgcaagaacggcaagcgggucauccagcugagccgcaagaccuucgacaccgaguaccagaagaccaagaacaacgacugggacuacguggugacgaccgacaucuccgagaugggggccaacuuccgggccgaccgcgucaucgacccccggcgcugccugaagcccgugauccucaaggacggccccgagcgggugauccuggccgggccgaugcccgucaccguggcgagcgccgcccagcgccggggccgcaucggccggaaccagaacaaggagggggaccaguacguguacaugggccagccccugaacaacgacgaggaccacgcccacuggaccgaggccaagaugcuccuggacaacaucaacacgcccgaggggaucaucccggcgcuguucgagcccgagcgcgagaaguccgccgccaucgacggcgaguaccgccuccgcggggaggcccgcaagaccuucgucgagcugaugcggcgcggcgaccugcccguguggcucagcuacaaggucgccuccgagggcuuccaguacagcgaccggcgcuggugcuucgacggggagcggaacaaccaggugcuggaggagaacauggacguggagaucuggaccaaggagggcgagcgcaagaagcugcggccccgcuggcucgacgcgcggaccuacuccgacccgcuggcccugcgcgaguucaaggaguucgccgccgggcggcgcagcgucagcggcgaccucauccuggagaucggcaagcugccccagcaccucacccugcgggcccagaacgcgcuggacaaccucgugaugcugcacaacuccgagcagggcgggaaggccuaccgccacgccauggaggagcugcccgacacgaucgagacccucaugcugcuggcccucaucgcggugcugaccgggggcgucacccuguucuuccucagcgggaagggccugggcaagacguccaucgggcugcucugcgugaccgccagcuccgcccugcuguggauggccagcguggagccccacuggaucgccgcguccaucauccucgaguucuuccugaugguccugcucaucccggagcccgaccggcagcgcacgccccaggacaaccagcuggccuacguggugaucggccuccucuucaugauccugaccgucgccgccaacgagauggggcugcucgagacgaccaagaaggaccugggcaucgggcacguggccgcggagaaccaccagcacgccaccaugcuggacguggaccuccggccggccagcgccuggacccuguacgccgucgcgacgaccgugaucacccccaugaugcgccacaccaucgagaacacgaccgccaacaucucccugaccgccaucgccaaccaggccgcgauccucaugggccuggacaagggcuggcccaucagcaagauggacaucggggugccccugcucgcccugggcugcuacucccaggucaacccgcugacccucacggccgccgugcugaugcugguggcgcacuacgccaucaucgggcccggccuccaggccaaggccacccgggaggcccagaagcgcaccgcggccgggaucaugaagaaccccaccgucgacggcaucguggccaucgaccuggaccccguggucuacgacacgaaguucgagaagcagcugggccagaucaugcuccugauccugugcaccagccagauccuccugaugcgcaccaccugggcccugugcgaguccaucacgcucgccaccgggccgcugaccacccugugggagggcagccccgggaaguucuggaacacgaccaucgcgguguccauggccaacaucuuccggggcagcuaccucgccggcgccgggcuggccuucucccugaugaagucccucggcgggggccgccgggggaccggcgcgcagggcgagacccugggggagaaguggaagcgccagcugaaccagcucuccaagagcgaguucaacaucuacaagcggagcggcaucauggagguggaccgcuccgaggccaaggaggggcugaagcggggcgagacgaccaagcacgccgucagccgcgggaccgccaagcugcggugguucguggagcgcaaccuggugaagcccgagggcaaggucaucgaccucggcugcgggcggggcgggugguccuacuacugcgcgggccugaagaaggugaccgaggugaagggguacaccaagggcggccccgggcacgaggagccgauccccauggccacguacggcuggaaccugguccgccuccacagcgggaaggacguguucuucaugccgcccgagaagugcgacacccugcugugcgacaucggcgaguccagcccgaaccccaccaucgaggaggggcggacccuccgcgugcugaagauggucgagcccuggcugcggggcaaccaguucugcaucaagauccucaaccccuacaugccguccgugguggagacgcuggagcagaugcagcgcaaguacggcgggaugcugguccggaacccccucagccgcaacuccacccacgagauguacugggugagcugcggcaccgggaacaucguguccgccgucaacaugaccagccggaugcugcugaaccgcuucacgauggcccaccgcaagcccaccuacgagcgggacguggaccucggcgccggcacccgccacguggcggucgagcccgagguggccaaccuggacaucaucgggcagcggaucgagaacaucaagaacgagcacaaguccaccuggcacuacgacgaggacaacccguacaagacgugggccuaccacggcagcuacgaggugaagcccuccgggagcgccuccagcauggucaacggcguggugcgccugcucaccaagcccugggacgucauccccauggugacccagaucgccaugaccgacacgaccccguucgggcagcagcgggucuucaaggagaagguggacacccgcacgccccgggcgaagcgcggcacgacccagaucauggaggugaccgccaaguggcuguggggcuuccugucccggaacaagaagccccgcaucugcacccgggaggaguucacgcgcaagguccggagcaacgccgccaucggggccguguucguggacgagaaccaguggaacagcgcgaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggccaagggcucccgcgcgaucugguacauguggcucggcgcccgguuccuggaguucgaggcccugggguucaugaacgaggaccacugguucagccgcgagaacucccucagcggcgucgagggggagggccugcacaagcugggguacauccuccgggacaucuccaagaucccgggcggcaacauguacgccgacgacaccgccgggugggacacccgcaucacggaggacgaccugcagaacgaggcgaagaucaccgacaucauggagcccgagcacgcccugcucgccaccagcaucuucaagcugaccuaccagaacaagguggugcgcguccagcggcccgccaagaacggcacggugauggacgugaucucccgccgggaccagcgcgggagcggccaggucggcaccuacgggcugaacaccuucaccaacauggaggugcagcucauccggcagauggaguccgagggcaucuuccugcccagcgagcuggagacgccgaaccucgccaagcgcgugcuggacuggcuggagaagcacggggcggagcggcucaagcgcauggccaucuccggcgacgacugcgucgugaagcccaucgacgaccgguucgccaccgcccugaccgcccugaacgacauggggaagauccgcaaggacaucccccagugggagcccagcaagggcuggaacgacuggcagcaggucccguucugcucccaccacuuccaccagcucaucaugaaggacggccgggagaucgucgugcccugccgcaaccaggacgagcugguggggcgggcgcgcgucagccagggcgccggguggucccugcgggagaccgccugccucggcaagagcuacgcccagauguggcagcugauguacuuccaccgccgggaccugcgccucgccgcgaacgccaucugcuccgccgugcccguggacuggguccccaccagccggacgaccuggagcauccacgcccaccaccaguggaugaccaccgaggacaugcuguccguguggaaccgcguguggaucgaggagaacccguggauggaggacaagacgcacgucagcuccugggaggaggugcccuaccuggggaagcgcgaggaccaguggugcggcagccucaucggccugaccgcgcgggccaccugggccaccaacauccagguggccaucaaccagguccgccggcugaucgggaacgagaacuaccucgacuacaugacguccaugaagcgcuucaagaacgagagcgaccccgagggcgcccugugguga

SEQ ID NO: 8168 - RNA, 9879 nt, Artificial Sequence
  derived and/or modified CDS sequence (opt1) from DENV-1__KF973463__SS-prME
agcgugaccaugcugcucaugcugaugcccaccgcccuggccuuccaccucacgacccgcggcggggagccgcacaugaucgucuccaagcacgagcggggcaaggcgcugcuguucaagaccagcaccggggugaacaugugcacgcucaucgccauggaccugggcgagcugugcgaggacaccaugaccuacaagugcccccgcaucaccgaggccgagcccgacgacguggacugcuggugcaacgccacggacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcaaccgcgacuucguggaggggcucuccggcgccaccuggguggacgucgugcuggagcacgggagcugcgugaccaccauggccaagaacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccuccugaccugcgccaaguucaagugcgugaccaagcuggagggcaagaucguccaguacgagaaccucaaguacagcgugaucgugaccguccacacgggcgaccagcaccagguggggaacgagaccaccgagcacggcaccaucgcgaccaucacgccccaggcccccaccuccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccuccaccagccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaccagcuacgucaugugcacgggguccuucaagcuggagaaggagguggcggagacccagcacggcaccgugcugguccaggugaaguacgagggcaccgacgcccccugcaagauccccuucagcacgcaggacgagaagggggugacccagaacggccggcugaucaccgccaacccgaucgucaccgacaaggagaagcccgugaacaucgagacggagccccccuucggggaguccuacaucguggucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagguguucggcacggccuacggggugcuguucuccggcgucagcuggaccaugaagaucgggaucggcauccugcucaccuggcugggccugaacucccgcagcaccucccucagcaugacgugcaucgccguggggauggugacccuguaccugggcgucauggugcaggccgacuccgggugcgugaucaacuggaagggccgggagcucaagugcgggagcggcaucuucgucaccaacgaggugcacaccuggaccgagcaguacaaguuccaggccgacuccccgaagcgccugagcgcggccaucggcaaggccugggaggagggggugugcggcauccggagcgccacgcgccuggagaacaucauguggaagcagaucuccaacgagcucaaccacauccugcuggagaacgacaugaaguucaccgucguggugggggacgccaacggcauccucgcgcaggggaagaagaugauccggccccagcccauggagcacaaguacagcuggaaguccuggggcaaggccaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcugcgggacagcuacacccagaugugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaccuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcuccccccccugcgcuuccggggggaggacggcugcugguacgggauggagauccgccccgugaaggagaaggaggagaaccugguccgguccauggugagcgccggcuccggcgagguggacagcuucagccucgggauccugugcgucuccaucaugaucgaggaggugaugcgcagccgguggucccgcaagaugcugaugaccggcacccucgccguguuccugcugcucaucauggggcagcugaccuggaacgaccugauccgccucugcaucauggucggcgccaacgcgagcgacaagauggggaugggcacgaccuaccuggcccugauggccaccuucaagaugcggccgauguucgccgugggcauccucuuccgccggcugaccucccgcgaggugcugcuccugacgaucgggcugagccucgucgccuccguggagcugcccaacagccuggaggagcucggcgacgggcuggcgaugggcaucaugaugcugaagcuccugaccgaguuccagccccaccagcuguggaccacccuccugucccugacguucaucaagaccacccucagccuggacuacgccuggaagaccacggccauggcccuguccaucgucagccucuucccccugugccuguccaccaccagccagaagaccaccuggcucccggugcugcugggcuccuucgggugcaagccccucacgauguuccugaucaccgagaacaagaucuggggccggaagagcuggcccaucaacgaggggaucauggcgaucggcaucguguccauccugcucagcucccugcugaagaacgacgucccccucgccgggccgcugaucgccggcggcaugcugaucgccugcuacgugaucagcgggagcuccgccgaccucagccuggagaaggcggccgagguguccugggagcaggaggccgagcacagcggcaccucccacaacauccuggucgaggugcaggacgacgggaccaugcgcaucaaggacgaggagaaggacgacacgcucaccauccugcugaaggccacccuccuggccgugagcggcgucuaccccauguccauccccgcgacccuguucgugugguacuucuggcagaagaagaagcagcggagcggggugcucugggacacgcccuccccgcccgaggucgagcgcgccgugcuggacgacggcaucuaccggauccugcagcgcggccuccuggggcggagccaggugggcgucgggguguuccaggacggcguguuccacaccauguggcacgucacccgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagacgacccccggcaccuucaagaccuccgagggcgaggugggggcgaucgcccuggacuucaagcccggcacgagcgggucccccaucgugaaccgggagggcaagaucgucggccuguacgggaacggcguggugaccaccagcgggaccuacgucuccgccaucgcccaggccaagacgagccaggagggcccgcuccccgagaucgaggacgagguguucaagaagcgcaaccugaccaucauggaccugcaccccgggagcggcaagacccggcgcuaccucccggcgaucgugcgggaggccaucaagaagaagcugcgcacccugauccucgcccccacgcgggucguggccuccgagauggcggaggcccugaagggcaugcccauccgcuaccagaccaccgccgugaagagcgagcacaccgggcgcgagaucgucgaccugaugugccacgccacguucaccaugcggcuccugucccccgugcgcgugccgaacuacaacaugaucaucauggacgaggcccacuucaccgaccccgcgagcaucgccgcccggggcuacaucuccacccgcgucgggaugggcgaggccgccgcgaucuucaugacggccaccccccccgggagcguggaggccuucccgcaguccaacgccgugauccaggacgaggagcgggacauccccgagcgcagcuggaacuccggcuacgacuggaucaccgacuuccccggcaagaccgucugguucgugcccagcaucaaguccgggaacgacaucgccaacugccugcggaagaacggcaagcgcgugauccagcucagccggaagacguucgacaccgaguaccagaagaccaagaacaacgacugggacuacgucgugaccacggacaucuccgagaugggggcgaacuuccgcgccgaccgggugaucgacccgcgccggugccugaagcccgucauccugaaggacggccccgagcgcgugauccucgccgggcccaugccggugaccgucgccagcgcggcccagcggcgcggccggaucggccgcaaccagaacaaggagggggaccaguacguguacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggacgaaggagggcgagcggaagaagcugcgcccccgguggcuggacgcccgcaccuacuccgacccccucgcgcugcgggaguucaaggaguucgccgccgggcgccggagcgugagcggcgaccugauccucgagaucggcaagcugccgcagcaccugacccuccgcgcccagaacgcccuggacaaccuggucaugcuccacaacuccgagcaggggggcaaggcguaccggcacgccauggaggagcugcccgacaccaucgagacgcugaugcuccuggcccugaucgccgugcucaccgggggcgugacccuguucuuccugagcgggaagggccucggcaagaccuccaucgggcugcugugcgucacggcgagcuccgcccuccuguggauggccagcguggagccccacuggaucgccgccuccaucauccuggaguucuuccucauggugcugcugauccccgagccggaccgccagcggaccccccaggacaaccagcucgcguacgucgugaucggccugcuguucaugauccucaccguggccgccaacgagauggggcugcuggagaccacgaagcgcgaccucggcaucgggcacgucgccgccgagaaccaccagcacgcgaccaugcuggacguggaccugcggcccgccagcgccuggacccucuacgccguggccaccacggucaucaccccgaugaugcgccacaccaucgagaacaccacggcgaacaucucccugaccgccaucgccaaccaggccgccauccugaugggccucgacaagggcuggcccaucagcaagauggacaucggggugccccugcuggcgcucggcugcuacucccaggugaacccccugacccugaccgccgccguccucaugcugguggcccacuacgcgaucaucgggccgggccugcaggccaaggccacgcgggaggcccagaagcgcaccgccgcggggaucaugaagaaccccaccguggacggcaucgucgccaucgaccucgaccccgugguguacgacgccaaguucgagaagcagcugggccagaucaugcugcucauccugugcaccagccagauccugcucaugcgcacgaccugggcccugugcgaguccaucacccuggccaccgggccccucacgacccugugggagggcagcccggggaaguucuggaacaccaccaucgcggucuccauggccaacaucuuccggggcagcuaccuggccggcgccgggcucgccuucucccugaugaagagccugggcgggggccgccgggggacgggcgcgcagggcgagacccucggggagaaguggaagcgccagcugaaccagcuguccaagcccgaguucaacaccuacaagcggagcggcaucauggagguggaccgcagcgaggccaaggaggggcucaagcggggcgagaccaccaagcacgccgugucccgcgggacggccaagcugcggugguucgucgagcgcaaccuggugaagcccgagggcaaggugaucgaccucggcugcgggcggggcggguggagcuacuacugcgcgggccugaagaaggucaccgaggugaagggguacaccaagggcggccccgggcacgaggagccgauccccauggccaccuacggcuggaaccuggugaagcugcacuccgggaaggacgucuucuucaugccccccgagaagugcgacacgcuccugugcgacaucggcgagagcuccccgaaccccaccaucgaggaggggcgcacccugcgggugcucaagaugguggagcccuggcugcgcggcaaccaguucugcaucaagauccugaaccccuacaugccgagcgucguggagacccucgagcagaugcagcggaagcacggcgggaugcuggugcgcaacccccugucccggaacagcacgcacgagauguacugggucuccugcggcaccgggaacaucgugagcgccgugaacaugaccucccgcaugcuccugaaccgguucaccauggcccaccgcaagcccacguacgagcgcgacgucgaccugggcgccggcacccggcacguggcgguggagcccgaggucgccaaccucgacaucaucgggcagcgcaucgagaacaucaagaacgagcacaagagcaccuggcacuacgacgaggacaacccguacaagaccugggccuaccacggcuccuacgaggugaagcccagcggguccgccagcuccauggugaacggcgucgugcggcugcugacgaagcccugggacgucauccccauggugacccagaucgccaugaccgacaccacgccguucgggcagcagcgcguguucaaggagaaggucgacacccggaccccccgcgcgaagcggggcaccacgcagaucauggaggugaccgccaaguggcucuggggcuuccugagccgcaacaagaagccccggaucugcacccgcgaggaguucacccggaaggugcgcuccaacgccgccaucggggccgucuucguggacgagaaccaguggaacagcgcgaaggaggccguggaggacgagcgguucugggaccugguccaccgcgagcgggagcuccacaagcagggcaagugcgccacgugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgccgacgacaccgccgggugggacacccggaucaccgaggacgaccuccagaacgaggcgaagaucacggacaucauggagcccgagcacgcccugcuggccaccuccaucuucaagcucaccuaccagaacaaggucgugcgcgugcagcgccccgccaagaacggcaccgucauggacgugaucagccggcgcgaccagcggggguccggccaggugggcacguacgggcugaacaccuucaccaacauggagguccagcugauccgccagauggagagcgagggcaucuuccuccccuccgagcuggagaccccgaaccuggccgagcgggugcucgacuggcuggagaagcacggggcggagcgccugaagcggauggccaucagcggcgacgacugcguggucaagcccaucgacgaccgcuucgccaccgcccucacggcccugaacgacauggggaaggugcggaaggacaucccccagugggagcccuccaagggcuggaacgacuggcagcaggugccguucugcagccaccacuuccaccagcugaucaugaaggacggccgcgagaucgucgugcccugccggaaccaggacgagcucguggggcgcgcgcgggucucccagggcgccggguggagccugcgcgagaccgccugccugggcaaguccuacgcccagauguggcagcucauguacuuccaccggcgcgaccugcggcuggccgcgaacgccaucugcagcgccgugcccguggacuggguccccaccucccgcaccacguggagcauccacgcccaccaccaguggaugaccaccgaggacaugcucagcguguggaaccggguguggaucgaggagaacccguggauggaggacaagacccacgucuccagcugggaggaggugcccuaccuggggaagcgcgaggaccaguggugcggcucccugaucggccucacggcgcgcgccaccugggccaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8169 - RNA, 9879 nt, Artificial Sequence
  derived and/or modified CDS sequence (opt1) from DENV-1__KF973464__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccgccgggacaagcgcuccguggcccuggcgccccacgugggccuggggcucgagacccggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucaucucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaucuucaagacccccgagggcgaggugggggccaucgcccuggacuucaagcccggcaccagcggguccccgaucgugaaccgggagggcaagaucgucggccuguacgggaacggcguggugaccacgagcgggaccuacgucuccgccaucgcccaggcgaaggccagccaggagggcccccuccccgagaucgaggacgagguguucaagaagcgcaaccugaccaucauggaccugcacccggggagcggcaagacccggcgcuaccuccccgccauggugcgggaggccaucaagcgcaagcugcggacgcugauccucgcgcccacccgcgucguggccuccgagauggccgaggcccugaagggcaugcccauccgcuaccagaccaccgccgucaagagcgagcacacggggcgggagaucgucgaccugaugugccacgcgaccuucaccaugcgccuccuguccccggugcgggugcccaacuacaacaugaucaucauggacgaggcccacuucaccgaccccgccagcaucgccgcccgcggcuacaucuccacgcgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucaccgacuuccccggcaagacggucugguucgugcccagcaucaaguccgggaacgacaucgccaacugccugcgcaagaacggcaagcgggugauccagcucagccgcaagaccuucgacaccgaguaccagaagaccaagaacaacgacugggacuacgucgugacgaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacccuccgggcgcagaacgcccuggacaaccuggucaugcuccacaacuccgagcagggcgggaaggccuaccgccacgccauggaggagcugcccgacacgaucgagacccugaugcuccuggcgcugaucgccgugcucaccgggggcgugacccuguucuuccugagcgggaagggccucggcaagacguccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagacgaccaagaaggaccucggcaucgggcacgucgcggccgagaaccaccagcacgccaccaugcuggacguggaccugcggccggccagcgccuggacccucuacgcgguggccacgaccgucaucacccccaugaugcgccacaccaucgagaacacgaccgccaacaucucccugaccgccaucgccaaccaggcggccauccugaugggccucgacaagggcuggcccaucagcaagauggacaucggggugccccugcuggcccucggcugcuacucccaggugaacccgcugacccugacggccgcgguccucaugcugguggcccacuacgccaucaucgggcccggccugcaggccaaggccacccgggaggcgcagaagcgcaccgccgccgggaucaugaagaaccccaccguggacggcaucgucgccaucgaccucgaccccgugguguacgacacgaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccgucuccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacaucuacaagcggagcggcaucauggagguggaccgcuccgaggccaaggaggggcucaagcggggcgagacgaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacaccaagggcggccccgggcacgaggagccgauccccauggccacguacggcuggaaccuggugaagcugcacagcgggaaggacgucuucuucaugccgcccgagaagugcgacacccuccugugcgacaucggcgaguccagcccgaaccccaccaucgaggaggggcgcacccugcgggugcucaagaugguggagcccuggcugcgcggcaaccaguucugcaucaagauccugaaccccuacaugccguccgucguggagacgcucgagcagaugcagcggaaguacggcgggaugcuggugcgcaacccccugagccggaacuccacccacgagauguacugggucagcugcggcaccgggaacaucguguccgccgugaacaugaccagccgcaugcuccugaaccgguucacgauggcccaccgcaagcccaccuacgagcgcgacgucgaccugggcgcgggcacccggcacguggccguggagcccgaggucgccaaccucgacaucaucgggcagcgcaucgagaacaucaagaacgagcacaaguccaccuggcacuacgacgaggacaacccguacaagacgugggccuaccacggcagcuacgaggugaagcccuccgggagcgccuccagcauggugaacggcgucgugcggcugcugaccaagcccugggacgugauccccauggucacccagaucgcgaugaccgacacgaccccguucgggcagcagcgcguguucaaggagaaggucgacacccggacgccccgggccaagcggggcacgacccagaucauggaggugaccgccaaguggcucuggggcuuccugucccgcaacaagaagccccggaucugcacccgcgaggaguucacgcggaaggugcgcagcaacgccgccaucggggcggucuucguggacgagaaccaguggaacagcgccaaggaggccguggaggacgagcgguucugggaccugguccaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagaucccgggcggcaacauguacgccgacgacaccgcggggugggacacccggaucacggaggacgaccuccagaacgaggccaagaucaccgacaucauggagcccgagcacgcccugcuggccaccagcaucuucaagcucaccuaccagaacaaggucgugcgcgugcagcgccccgccaagaacggcacggucauggacgugaucucccggcgcgaccagcgggggagcggccaggugggcaccuacgggcugaacaccuucaccaacauggagguccagcugauccgccagauggaguccgagggcaucuuccuccccagcgagcuggagacgccgaaccuggcggagcgggugcucgacuggcuggagaagcacggggccgagcgccugaagcggauggccaucuccggcgacgacugcguggucaagcccaucgacgaccgcuucgccaccgcccucaccgcgcugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagaccgccugccugggcaagagcuacgcccagauguggcagcucauguacuuccaccggcgcgaccugcggcuggcggccaacgccaucugcuccgccgugcccguggacuggguccccaccagccgcacgaccuggagcauccacgcgcaccaccaguggaugaccaccgaggacaugcucuccguguggaaccggguguggaucgaggagaacccguggauggaggacaagacgcacgucagcuccugggaggaggugcccuaccuggggaagcgcgaggaccaguggugcggcagccugaucggccucaccgcccgcgccaccugggccaccaacauccagguggccaucaaccagguccggcgccugaucgggaacgagaacuaccuggacuacaugacguccaugaagcgguucaagaacgagagcgaccccgagggcgcgcucugguga

SEQ ID NO: 8170 - RNA, 9879 nt, Artificial Sequence
  derived and/or modified CDS sequence (opt1) from DENV-1__KF973465__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccagaucaccgaggccgagcccgacgacguggacugcuggugcaacgccaccgacaccugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaugggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgagcugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcacccuggccgucuuccugcuccugaucauggggcagcugaccuggaacgaccucauccgccugugcaucauggugggcgcgaacgccuccgaccgcauggggaugggcaccacguaccuggcccucauggccaccuucaagaugcggccgauguucgccguggggcugcuguuccgccggcucaccagccgcgagguccugcugcucaccaucgggcugucccugguggcgagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggaagaccaccgccauggcgcugagcaucaucucccuguucccccucugccugagcacgaccucccagaagaccaccuggcugccgguccuccugggcagcuucgggugcaagccccugaccauguuccucaucacggagaacaagaucuggggccggaaguccuggccccugaacgaggggaucauggccaucggcaucgugagcauccugcucuccagccugcugaagaacgacgucccccucgccgggccgcugaucgccggcggcaugcugaucgccugcuacgugaucagcggguccagcgcggaccucucccuggagaaggccgccgaggugagcugggagcaggaggccgagcacuccggcaccagccacaacauccuggucgaggugcaggacgacgggaccaugaagaucaaggacgaggagcgcgacgacacccucacgauccugcugaaggccacccuccuggcgguguccggcgucuaccccaugagcauccccgccacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgcgguggagcccgggaagaacccgaagaacguccagaccacgcccggcaccuucaagacccccgagggcgaggugggggccaucgcccuggacuucaagcccggcaccagcggguccccgaucgugaaccgggagggcaagaucgucggccuguacgggaacggcguggugacgaccagcgggaccuacgucuccgccaucgcccaggcgaaggccagccaggagggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcgcccacccgcgucguggccuccgagauggccgaggcccugaagggcaugcccauccgcuaccagaccacggccgucaagagcgagcacaccgggcgggagaucgucgaccugaugugccacgcgaccuucaccaugcgccuccuguccccggugcgggugcccaacuacaacaugaucaucauggacgaggcccacuucacggaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgcggggccgaugcccgugaccgucgccagcgccgcccagcgccggggccgcaucggccggaaccagaacaaggagggggaccaguacguguacaugggccagccccugaacaacgacgaggaccacgcccacuggacggaggcgaagaugcugcucgacaacaucaacacccccgaggggaucaucccggcccuguucgagcccgagcgcgagaaguccgccgccaucgacggcgaguaccgccugcgcggggaggcccgcaagaccuucguggagcucaugcggcgcggcgaccugcccgucuggcugagcuacaagguggcguccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcccggaccuacuccgacccgcucgcccugcgcgaguucaaggaguucgccgccgggcggcgcagcgugagcggcgaccugauccucgagaucggcaagcugccccagcaccugacgcuccgggcgcagaacgcccuggacaaccuggucaugcuccacaacuccgagcagggcgggaaggccuaccgccacgccauggaggagcugcccgacaccaucgagacccugaugcuccuggcgcugaucgccgugcucaccgggggcgugacgcuguucuuccugagcgggaagggccucggcaagaccuccaucgggcugcugugcgucaccgccagcuccgcccuccuguggauggccagcguggagccccacuggaucgcggccuccaucauccuggaguucuuccucauggugcugcugaucccggagcccgaccggcagcgcacgccccaggacaaccagcucgccuacgucgugaucggccugcuguucaugauccucacgguggccgccaacgagauggggcugcuggagaccaccaagaaggaccucggcaucgggcacgucgcggccgagaaccaccagcacgccaccaugcuggacguggaccugcggccggccagcgccuggacgcucuacgcgguggccaccaccgucaucacccccaugaugcgccacacgaucgagaacaccaccgccaacaucucccugaccgccaucgccaaccaggcggccauccugaugggccucgacaagggcuggcccaucagcaagauggacaucggggugccccugcuggcccucggcugcuacucccaggugaacccgcugacgcugaccgccgcgguccucaugcugguggcccacuacgccaucaucgggcccggccugcaggccaaggccacccgggaggcgcagaagcgcaccgccgccgggaucaugaagaaccccacgguggacggcaucgucgccaucgaccucgaccccgugguguacgacaccaaguucgagaagcagcugggccagaucaugcugcucauccugugcaccagccagauccugcucaugcgcaccacgugggcccugugcgaguccaucacccuggcgaccgggccgcucaccacgcugugggagggcagccccgggaaguucuggaacaccaccaucgccgucuccauggccaacaucuuccggggcagcuaccuggccggcgccgggcucgcguucucccugaugaagucccugggcgggggccgccgggggaccggcgcccagggcgagacgcucggggagaaguggaagcgccagcugaaccagcuguccaagagcgaguucaacaucuacaagcggagcggcaucauggagguggaccgcuccgaggccaaggaggggcucaagcggggcgagaccaccaagcacgccgugagccgcgggaccgcgaagcugcggugguucgucgagcgcaaccuggugaagcccgagggcaaggugaucgaccugggcugcgggcggggcgggugguccuacuacugcgccggccucaagaaggucaccgaggugaagggguacacgaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccaccaucgaggaggggcgcacgcugcgggugcucaagaugguggagcccuggcugcgcggcaaccaguucugcaucaagauccugaaccccuacaugccguccgucguggagacccucgagcagaugcagcggaaguacggcgggaugcuggugcgcaacccccugagccggaacuccacccacgagauguacugggucagcugcggcaccgggaacaucguguccgccgugaacaugacgagccgcaugcuccugaaccgguucaccauggcccaccgcaagcccaccuacgagcgcgacgucgaccugggcgcgggcacccggcacguggccguggagcccgaggucgccaaccucgacaucaucgggcagcgcaucgagaacaucaagaacgagcacaaguccacguggcacuacgacgaggacaacccguacaagaccugggccuaccacggcagcuacgaggugaagcccuccgggagcgccuccagcauggugaacggcgucgugcggcugcugaccaagcccugggacgugauccccauggucacccagaucgcgaugacggacaccaccccguucgggcagcagcgcguguucaaggagaaggucgacacccggacgccccgcgccaagcggggcaccacccagaucauggaggugaccgccaaguggcucuggggcuuccugucccgcaacaagaagccccggaucugcacgcgcgaggaguucacccggaaggugcgcagcaacgccgccaucggggcggucuucguggacgagaaccaguggaacagcgccaaggaggccguggaggacgagcgguucugggaccugguccgccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgccgacgacaccgcggggugggacacgcgcaucaccgaggacgaccuccagaacgaggccaagaucaccgacaucauggagcccgagcacgcccugcuggccaccagcaucuucaagcucacguaccagaacaaggucgugcgcgugcagcggcccgccaagaacggcaccgucauggacgugaucucccgccgggaccagcgcgggagcggccaggugggcaccuacgggcugaacaccuucacgaacauggagguccagcugauccggcagauggaguccgagggcaucuuccuccccagcgagcuggagaccccgaaccuggcggagcgcgugcucgacuggcuggagaagcacggggccgagcggcugaagcgcauggccaucuccggcgacgacugcguggucaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucgucgugcccugccgcaaccaggacgagcucguggggcgggcccgcgucagccagggcgccggguggucccugcgggagaccgccugccugggcaagagcuacgcccagauguggcagcucauguacuuccaccgccgggaccugcgccuggcggccaacgccaucugcuccgccgugcccguggacuggguccccacgagccggaccaccuggagcauccacgcgcaccaccaguggaugaccacggaggacaugcucuccguguggaaccgcguguggaucgaggagaacccguggauggaggacaagacccacgucagcuccugggaggaggugcccuaccuggggaagcgcgaggaccaguggugcggcagccugaucggccucaccgcccgggccaccugggccacgaacauccagguggccaucaaccagguccgccggcugaucgggaacgagaacuaccuggacuacaugaccuccaugaagcgcuucaagaacgagagcgaccccgagggcgcgcucugguga

SEQ ID NO: 8171 - RNA, 9879 nt, Artificial Sequence
  derived and/or modified CDS sequence (opt1) from DENV-1__KF973466__SS-prME
agcgugaccaugcugcucaugcugaugcccaccgcccuggccuuccaccucacgacccgcggcggggagccgcacaugaucgucuccaagcacgagcggggcaaggcgcugcuguucaagaccagcaccggggugaacaugugcacgcucaucgccauggaccugggcgagcugugcgaggacaccaugaccuacaagugcccccgcaucaccgaggccgagcccgacgacguggacugcuggugcaacgccacggacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcaaccgcgacuucguggaggggcucuccggcgccaccuggguggacgucgugcuggagcacgggagcugcgugaccaccauggccaagaacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccuccugaccugcgccaaguucaagugcgugaccaagcuggagggcaagaucguccaguacgagaaccucaaguacagcgugaucgugaccguccacacgggcgaccagcaccagguggggaacgagaccaccgagcacggcaccaucgcgaccaucacgccccaggcccccaccuccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccuccaccagccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaccagcuacgucaugugcacgggguccuucaagcuggagaaggagguggcggagacccagcacggcaccgugcugguccaggugaaguacgagggcaccgacgcccccugcaagauccccuucagcacgcaggacgagaagggggugacccagaacggccggcugaucaccgccaacccgaucgucaccgacaaggagaagcccgugaacaucgagacggagccccccuucggggaguccuacaucguggucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagguguucggcacggccuacggggugcuguucuccggcgucagcuggaccaugaagaucgggaucggcauccugcucaccuggcugggccugaacucccgcagcaccucccucagcaugacgugcaucgccguggggauggugacccuguaccugggcgucauggugcaggccgacuccgggugcgugaucaacuggaagggccgggagcucaagugcgggagcggcaucuucgucaccaacgaggugcacaccuggaccgagcaguacaaguuccaggccgacuccccgaagcgccugagcgcggccaucggcaaggccugggaggagggggugugcggcauccggagcgccacgcgccuggagaacaucauguggaagcagaucuccaacgagcucaaccacauccugcuggagaacgacaugaaguucaccgucguggugggggacgccaacggcauccucgcgcaggggaagaagaugauccggccccagcccauggagcacaaguacagcuggaaguccuggggcaaggccaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcugcgggacagcuacacccagaugugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaccuggcccaagucccacacccuguggagcaacggcguccucgaguccgagaugaucauccccaagaucuacgggggcccgaucagccagcacaacuaccgccccggguacuucacgcagaccgccggccccuggcaccuggggaagcuggagcucgacuucgaccugugcgagggcaccaccgugguggucgacgagcacugcggcaaccgggggccgucccugcgcacgaccaccgugaccggcaagaucauccacgaguggugcugccggagcugcacgcuccccccccugcgcuuccggggggaggacggcugcugguacgggauggagauccgccccgugaaggagaaggaggagaaccugguccgguccauggugagcgccggcuccggcgagguggacagcuucagccucgggauccugugcgucuccaucaugaucgaggaggugaugcgcagccgguggucccgcaagaugcugaugaccggcacccucgccguguuccugcugcucaucauggggcagcugaccuggaacgaccugauccgccucugcaucauggucggcgccaacgcgagcgaccggauggggaugggcacgaccuaccuggcccugauggccaccuucaagaugcgcccgauguucgccgugggcauccucuuccggcgccugaccucccgggaggugcugcuccugacgaucgggcugagccucgucgccuccguggagcugcccaacagccuggaggagcucggcgacgggcuggcgaugggcaucaugaugcugaagcuccugaccgaguuccagccccaccagcuguggaccacccuccugucccugacguucaucaagaccacccucagccuggacuacgccuggaagaccacggccauggcccuguccaucgucagccucuucccccugugccuguccaccaccagccagaagaccaccuggcucccggugcugcugggcuccuucgggugcaagccccucacgauguuccugaucaccgagaacaagaucuggggccgcaagagcuggcccaucaacgaggggaucauggcgaucggcaucguguccauccugcucagcucccugcugaagaacgacgucccccucgccgggccgcugaucgccggcggcaugcugaucgccugcuacgugaucagcgggagcuccgccgaccucagccuggagaaggcggccgagguguccugggagcaggaggccgagcacagcggcaccucccacaacauccuggucgaggugcaggacgacgggaccaugcggaucaaggacgaggagaaggacgacacgcucaccauccugcugaaggccacccuccuggccgugagcggcgucuaccccauguccauccccgcgacccuguucgugugguacuucuggcagaagaagaagcagcgcagcggggugcucugggacacgcccuccccgcccgaggucgagcgggccgugcuggacgacggcaucuaccgcauccugcagcggggccuccuggggcgcagccaggugggcgucgggguguuccaggacggcguguuccacaccauguggcacgucacccggggggccgugcugauguaccagggcaagcgccuggagcccuccugggccagcgugaagaaggaccucaucuccuacggcgggggcuggcgguuccaggggagcuggaacaccggcgaggagguccaggugaucgccguggagcccgggaagaacccgaagaacguccagacgacccccggcaccuucaagaccuccgagggcgaggugggggcgaucgcccuggacuucaagcccggcacgagcgggucccccaucgugaaccgcgagggcaagaucgucggccuguacgggaacggcguggugaccaccagcgggaccuacgucuccgccaucgcccaggccaagacgagccaggagggcccgcuccccgagaucgaggacgagguguucaagaagcggaaccugaccaucauggaccugcaccccgggagcggcaagacccgccgguaccucccggcgaucgugcgcgaggccaucaagcggaagcugcgcacccugauccucgcccccacgcgcgucguggccuccgagauggcggaggcccugaagggcaugcccauccgguaccagaccaccgccgugaagagcgagcacaccgggcgcgagaucgucgaccugaugugccacgccacguucaccaugcggcuccugucccccgugcgcgugccgaacuacaacaugaucaucauggacgaggcccacuucaccgaccccgcgagcaucgccgcccggggcuacaucuccacccgcgucgggaugggcgaggccgccgcgaucuucaugacggccaccccccccgggagcguggaggccuucccgcaguccaacgccgugauccaggacgaggagcgggacauccccgagcgcagcuggaacuccggcuacgacuggaucaccgacuuccccggcaagaccgucugguucgugcccagcaucaaguccgggaacgacaucgccaacugccugcggaagaacggcaagcgcgugauccagcucagccggaagacguucgacaccgaguaccagaagaccaagaacaacgacugggacuacgucgugaccacggacaucuccgagaugggggcgaacuuccgcgccgaccgggugaucgacccgcgccggugccugaagcccgucauccugaaggacggccccgagcgcgugauccucgccgggcccaugccggugaccgucgccagcgcggcccagcggcgcggccggaucggccgcaaccagaacaaggagggggaccaguacguguacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggacgaaggagggcgagcggaagaagcugcgcccccgguggcuggacgcccgcaccuacuccgacccccucgcgcugcgggaguucaaggaguucgccgccgggcgccggagcgugagcggcgaccugauccucgagaucggcaagcugccgcagcaccugacccuccgcgcccagaacgcccuggacaaccuggucaugcuccacaacuccgagcaggggggcaaggcguaccggcacgccauggaggagcugcccgacaccaucgagacgcugaugcuccuggcccugaucgccgugcucaccgggggcgugacccuguucuuccugagcgggaagggccucggcaagaccuccaucgggcugcugugcgucacggcgagcuccgcccuccuguggauggccagcguggagccccacuggaucgccgccuccaucauccuggaguucuuccucauggugcugcugauccccgagccggaccgccagcggaccccccaggacaaccagcucgcguacgucgugaucggccugcuguucaugauccucaccguggccgccaacgagauggggcugcuggagaccacgaagcgcgaccucggcaucgggcacgucgccgccgagaaccaccagcacgcgaccaugcuggacguggaccugcggcccgccagcgccuggacccucuacgccguggccaccacggucaucaccccgaugaugcgccacaccaucgagaacaccacggcgaacaucucccugaccgccaucgccaaccaggccgccauccugaugggccucgacaagggcuggcccaucagcaagauggacaucggggugccccugcuggcgcucggcugcuacucccaggugaacccccugacccugaccgccgccguccucaugcugguggcccacuacgcgaucaucgggccgggccugcaggccaaggccacgcgcgaggcccagaagcggaccgccgcggggaucaugaagaaccccaccguggacggcaucgucgccaucgaccucgaccccgugguguacgacgccaaguucgagaagcagcugggccagaucaugcugcucauccugugcaccagccagauccugcucaugcgcacgaccugggcccugugcgaguccaucacccuggccaccgggccccucacgacccugugggagggcagcccggggaaguucuggaacaccaccaucgcggucuccauggccaacaucuuccggggcagcuaccuggccggcgccgggcucgccuucucccugaugaagagccugggcgggggccgccgggggacgggcgcgcagggcgagacccucggggagaaguggaagcgccagcugaaccagcuguccaagcccgaguucaacaccuacaagcggagcggcaucauggagguggaccgcagcgaggccaaggaggggcucaagcggggcgagaccaccaagcacgccgugucccgcgggacggccaagcugcggugguucgucgagcgcaaccuggugaagcccgagggcaaggugaucgaccucggcugcgggcggggcggguggagcuacuacugcgcgggccugaagaaggucaccgaggugaagggguacaccaagggcggccccgggcacgaggagccgauccccauggccaccuacggcuggaaccuggugaagcugcacuccgggaaggacgucuucuucaugccccccgagaagugcgacacgcuccugugcgacaucggcgagagcuccccgaaccccaccaucgaggaggggcgcacccugcgggugcucaagaugguggagcccuggcugcgcggcaaccaguucugcaucaagauccugaaccccuacaugccgagcgucguggagacccucgagcagaugcagcggaagcacggcgggaugcuggugcgcaacccccugucccggaacagcacgcacgagauguacugggucuccugcggcaccgggaacaucgugagcgccgugaacaugaccucccgcaugcuccugaaccgcuucaccauggcccaccggaagcccacguacgagcgcgacgucgaccugggcgccggcacccggcacguggcgguggagcccgaggucgccaaccucgacaucaucgggcagcgcaucgagaacaucaagaacgagcacaagagcaccuggcacuacgacgaggacaacccguacaagaccugggccuaccacggcuccuacgaggugaagcccagcggguccgccagcuccauggugaacggcgucgugcggcugcugacgaagcccugggacgucauccccauggugacccagaucgccaugaccgacaccacgccguucgggcagcagcgcguguucaaggagaaggucgacacccggaccccccgcgcgaagcggggcaccacgcagaucauggaggugaccgccaaguggcucuggggcuuccugagccgcaacaagaagccccggaucugcacccgcgaggaguucacccggaaggugcgcuccaacgccgccaucggggccgucuucguggacgagaaccaguggaacagcgcgaaggaggccguggaggacgagcgguucugggaccugguccaccgcgagcgggagcuccacaagcagggcaagugcgccacgugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagaucccgggcggcaacauguacgccgacgacaccgccgggugggacacccgcaucaccgaggacgaccuccagaacgaggcgaagaucacggacaucauggagcccgagcacgcccugcuggccaccuccaucuucaagcucaccuaccagaacaaggucgugcgggugcagcgccccgccaagaacggcaccgucauggacgugaucagccggcgcgaccagcggggguccggccaggugggcacguacgggcugaacaccuucaccaacauggagguccagcugauccgccagauggagagcgagggcaucuuccuccccuccgagcuggagaccccgaaccuggccgagcgggugcucgacuggcuggagaagcacggggcggagcgccugaagcggauggccaucagcggcgacgacugcguggucaagcccaucgacgaccgcuucgccaccgcccucacggcccugaacgacauggggaaggugcggaaggacaucccccagugggagcccuccaagggcuggaacgacuggcagcaggugccguucugcagccaccacuuccaccagcugaucaugaaggacggccgcgagaucgucgugcccugccggaaccaggacgagcucguggggcgcgcgcgggucucccagggcgccggguggagccugcgcgagaccgccugccugggcaaguccuacgcccagauguggcagcucauguacuuccaccggcgcgaccugcggcuggccgcgaacgccaucugcagcgccgugcccguggacuggguccccaccucccgcaccacguggagcauccacgcccaccaccaguggaugaccaccgaggacaugcucagcguguggaaccgcguguggaucgaggagaacccguggauggaggacaagacccacgucuccagcugggaggaggugcccuaccuggggaagcgggaggaccaguggugcggcucccugaucggccucacggcgcgcgccaccugggccaccaacauccagguggccaucaaccagguccggcgccugaucgggaacgagaacuaccuggacuacaugaccagcaugaagcgguucaagaacgaguccgaccccgagggcgcccucugguga

SEQ ID NO: 8172 - RNA, 9879 nt, Artificial Sequence
  derived and/or modified CDS sequence (opt1) from DENV-1__KF973471__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccagaucaccgaggccgagcccgacgacguggacugcuggugcaacgccaccgacacgugggucaccuacgggaccugcagccagaccggcgagcaccggcgggacaagcgcuccguggcccuggcgccccacgugggccuggggcucgagacgcggaccgagaccuggaugagcagcgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgcgagcugaagugcggguccggcaucuucgugaccaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucacgguggucgugggggacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacaaccagcgggccuggaacaucugggagguggaggacuacggcuucgggaucuucacgaccaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagacgugcaccuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgccagcaucaugaucgaggaggugaugcggucccgcuggagccggaagaugcucaugacgggcaccccggccgucuuccugcugcucaucauggggcagcugaccuggaacgaccugauccgccucugcaucauggugggcgcgaacgccuccgaccgcauggggaugggcaccacguaccuggcccugauggccaccuucaagaugcggcccauguucgccgugggccuccuguuccgccggcugaccagccgcgagguccuccugcugaccaucgggcucucccugguggcgagcguggagcugcccaacucccucgaggagcugggcgacgggcuggccaugggcaucaugaugcucaagcugcugacggaguuccagccccaccagcucuggaccacccugcugagccucaccuucaucaagacgacccugucccuggacuacgccuggaagaccaccgccauggcgcucagcaucaucucccuguucccgcugugccucagcacgaccucccagaagaccaccuggcugcccguccugcucggcagcuucgggugcaagccccugaccauguuccugaucacggagaacaagaucuggggccggaaguccuggccccucaacgaggggaucauggccaucggcaucgugagcauccugcuguccagccuccugaagaacgacgucccgcuggccgggccccucaccgccggcggcaugcugaucgccugcuacgugaucagcggguccagcgcggaccugucccucgagaaggccgccgaggugagcugggagcaggaggccgagcacuccggcaccagccacaacauccuggucgaggugcaggacgacgggaccaugaagaucaaggacgaggagcgcgacgacacgcugaccauccuccugaaggccacccugcucgcgguguccggcgucuaccccaugagcauccccgccacccuguucgugugguacuucuggcagaagaagaagcagcgguccggggugcugugggacacgccguccccgcccgaggucgagcgcgccgugcucgacgacggcaucuaccggauccugcagcgcggccugcuggggcggucccaggugggcgucgggguguuccaggacggcguguuccacaccauguggcacgucacccgcggggccgugcucauguaccagggcaagcggcuggagcccagcugggccuccgugaagaaggaccugaucagcuacggcgggggcuggcgcuuccagggguccuggaacaccggcgaggagguccaggugaucgcgguggagccggggaagaaccccaagaacguccagacgacccccggcaccuucaagacccccgagggcgaggugggggccaucgcccucgacuucaagccgggcacgagcgggucccccaucgugaaccgggagggcaagaucgucggccuguacgggaacggcguggugaccaccagcgggaccuacgucuccgccaucgcccaggcgaaggccagccaggagggcccccugccggagaucgaggacgagguguucaagaagcgcaaccucacgaucauggaccugcaccccgggagcggcaagacccggcgcuaccugcccgccaucgugcgggaggccaucaagcgcaagcuccggacccugauccuggcgcccacccgcgucguggccuccgagauggccgaggcccucaagggcaugccgauccgcuaccagacgaccgccgucaagagcgagcacaccgggcgggagaucgucgaccugaugugccacgcgaccuucacgaugcgccugcucucccccgugcgggugcccaacuacaacaugaucaucauggacgaggcccacuucaccgaccccgccagcaucgccgcccgcggcuacaucuccacccgggucgggaugggcgaggcggccgccaucuucaugaccgccacgccgcccgggagcguggaggccuucccccaguccaacgcggugauccaggacgaggagcgcgacauccccgagcggagcuggaacuccggcuacgacuggaucaccgacuucccgggcaagaccgucugguucgugcccagcaucaaguccgggaacgacaucgccaacugccugcgcaagaacggcaagcgggugauccagcugagccgcaagaccuucgacacggaguaccagaagaccaagaacaacgacugggacuacgucgugaccaccgacaucuccgagaugggggccaacuuccgggccgaccgcgugaucgacccccggcgcugccucaagcccgucauccugaaggacggcccggagcgggugauccuggcggggcccaugcccgugacggucgccagcgccgcccagcgccggggccgcaucggccggaaccagaacaaggagggggaccaguacguguacaugggccagccccucaacaacgacgaggaccacgcccacuggaccgaggcgaagaugcugcuggacaacaucaacaccccggaggggaucauccccgcccucuucgagcccgagcgcgagaaguccgccgccaucgacggcgaguaccgccugcgcggggaggcccgcaagaccuucguggagcugaugcggcgcggcgaccuccccgucuggcugagcuacaagguggcguccgagggcuuccaguacagcgaccggcgcuggugcuucgacggggagcggaacaaccagguccuggaggagaacauggacguggagaucuggaccaaggagggcgagcgcaagaagcuccggccgcgcuggcuggacgcccggacguacuccgacccccuggcccuccgcgaguucaaggaguucgccgccgggcggcgcagcgugagcggcgaccugauccuggagaucggcaagcucccccagcaccugacccugcgggcgcagaacgcccucgacaaccuggucaugcugcacaacuccgagcagggcgggaaggccuaccgccacgccauggaggagcuccccgacaccaucgagacccugaugcugcucgcgcugaucgccgugcugaccggcggggugacccucuucuuccugagcgggaaggggcugggcaagaccuccaucgggcuccugugcgucaccgccagcuccgcccugcucuggauggccagcguggagccgcacuggaucgcggccuccaucauccuggaguucuuccugauggugcuccugauccccgagcccgaccggcagcgcacgccgcaggacaaccagcuggccuacgucgugaucggccuccuguucaugauccugaccguggccgccaacgagauggggcuccuggagaccaccaagaaggaccugggcaucgggcacgucgcggccgagaaccaccagcacgccacgaugcucgacguggaccugcggcccgccagcgccuggacccuguacgcgguggccaccaccgucaucacgcccaugaugcgccacaccaucgagaacaccaccgccaacaucucccucacggccaucgccaaccaggcggccauccugaugggccuggacaagggcuggcccaucagcaagauggacaucggggugccgcuccuggcccugggcugcuacucccaggugaacccccucacccugaccgccgcgguccugaugcucguggcccacuacgccaucaucgggcccggccugcaggccaaggccacccgggaggcgcagaagcgcacggccgccgggaucaugaagaaccccaccguggacggcaucgucgccaucgaccuggacccggugguguacgacaccaaguucgagaagcagcucggccagaucaugcugcugauccucugcaccagccagauccugcugaugcgcacgaccugggcccucugcgaguccaucacccuggcgaccgggccccugacgacccucugggagggcagccccgggaaguucuggaacaccaccaucgccgucuccauggccaacaucuuccggggcagcuaccuggccggcgccgggcuggcguucucccucaugaagucccugggcgggggccgccgggggacgggcgcccagggcgagacccugggggagaaguggaagcgccagcucaaccagcuguccaagagcgaguucaacaucuacaagcggagcggcaucauggagguggaccgcuccgaggccaaggaggggcugaagcggggcgagaccaccaagcacgccgugagccgcgggaccgcgaagcuccggugguucgucgagcgcaaccuggugaagcccgagggcaaggugaucgaccugggcugcgggcggggcgggugguccuacuacugcgccggccugaagaaggucacggaggugaagggguacaccaagggcggcccggggcacgaggagcccauccccauggccaccuacggcuggaaccucgugaagcugcacagcgggaaggacgucuucuucaugcccccggagaagugcgacacccugcucugcgacaucggcgaguccagccccaaccccacgguggaggaggggcgcacccugcgggugcugaagauggucgagcccuggcucaagggcaaccaguucugcaucaagauccugaacccguacaugcccuccgugguggagacccuggagcagaugcagcgcaaguacggcgggaugcucguccggaacccccugagccgcaacuccacccacgagauguacugggugagcugcggcacggggaacaucguguccgccgucaacaugaccagccggaugcugcucaaccgcuucaccauggcccaccggaagcccaccuacgagcgcgacguggaccugggcgcgggcacgcgccacguggccgucgagccggagguggccaaccuggacaucaucgggcagcggaucgagaacaucaagaacgagcacaaguccaccuggcacuacgacgaggacaaccccuacaagaccugggccuaccacggcagcuacgaggugaagcccuccgggagcgccuccagcauggucaacggcguggugcgccuccugaccaagcccugggacgucaucccgauggugacgcagaucgcgaugaccgacaccacccccuucgggcagcagcgggucuucaaggagaagguggacacgcgcacgccccgggccaagcgcggcaccacccagaucauggaggugacggccaaguggcuguggggcuuccucucccggaacaagaagccgcgcaucugcacccgggaggaguucacccgcaagguccggagcaacgccgccaucggggcgguguucguggacgagaaccaguggaacagcgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcucccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucuccaagauccccggcggcaacauguacgccgacgacacggcggggugggacacccgcaucaccgaggacgaccugcagaacgaggccaagaucaccgacaucauggagcccgagcacgcccuccuggccacgagcaucuucaagcugaccuaccagaacaagguggugcggguccagcgccccgccaagaacggcaccgugauggacgugaucucccgccgggaccagcgcgggagcggccaggucggcaccuacgggcucaacacguucaccaacauggaggugcagcugauccggcagauggaguccgagggcaucuuccugccgagcgagcucgagacccccaaccuggcggagcgcgugcuggacuggcucgagaagcacggggccgagcggcugaagcgcauggccaucuccggcgacgacugcgucgugaagcccaucgacgaccgguucgccaccgcccugaccgcgcucaacgacauggggaaggugcgcaaggacaucccccagugggagccgagcaagggcuggaacgacuggcagcagguccccuucugcucccaccacuuccaccagcugaucaugaaggacggccgggagaucguggugcccugccgcaaccaggacgagcuggucgggcgggcccgcgugagccagggcgccggguggucccuccgggagacggccugccugggcaagagcuacgcccagauguggcagcugauguacuuccaccgccgggaccuccgccuggcggccaacgccaucugcuccgccgugcccgucgacugggugccgaccagccggaccaccuggagcauccacgcgcaccaccaguggaugacgaccgaggacaugcuguccguguggaaccgcgucuggaucgaggagaaccccuggauggaggacaagacccacgugagcuccugggaggaggugcccuaccucgggaagcgggaggaccaguggugcggcagccugaucggccugaccgcccgcgccacgugggccaccaacauccaggucgccaucaaccaggugcgccggcucaucgggaacgagaacuaccuggacuacaugaccuccaugaagcgcuucaagaacgagagcgaccccgagggcgcgcugugguga

SEQ ID NO: 8173 - RNA, 9879 nt, Artificial Sequence
  derived and/or modified CDS sequence (opt1) from DENV-1__KF973472__SS-prME
agcgugaccaugcuccucaugcugcugcccaccgcccucgccuuccaccugaccacccggggcggggagccgcacaugaucgugagcaagcacgagcggggcaagagccuccuguucaagaccagcaccggggugaacaugugcacgcugaucgccauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgcgacaagcgguccguggcccuggcgccccacgugggccuggggcucgagacccgcaccgagaccuggaugagcuccgagggcgcguggaagcagauccagcgggucgagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccgugaccugcaucgccguggggauggucacgcucuaccugggcgugauggugcaggccgacagcgggugcgucaucaacuggaagggccgggagcugaagugcggguccggcaucuucgugaccaacgaggugcacaccuggaccgagcaguacaaguuccaggccgacagcccgaagcgccucagcgcggccaucggcaaggccugggaggagggggucugcggcauccgguccgccacccgccuggagaacaucauguggaagcagaucagcaacgagcugaaccacauccuccuggagaacgacaugaaguucacggugguggucggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggagguggaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggucaagacgugcaccuggcccaagagccacacccugugguccaacggcgugcuggagagcgagaugaucauccccaagaucuacgggggcccgaucucccagcacaacuaccgccccggguacuucacccagacggccggccccuggcaccucgggaagcuggagcuggacuucgaccucugcgagggcaccaccguggucguggacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgucaaggagaaggaggagaaccuggugcggagcaugguguccgccggcagcggcgaggucgacagcuucucccuggggauccucugcgugagcaucaugaucgaggaggugaugcgcucccgguggagccgcaagaugcugaugacgggcacccuggccgucuuccuccugcugaucauggggcagcucaccuggaacgaccugauccgccugugcaucauggugggcgccaacgcguccgaccggauggggaugggcaccacguaccucgcccugauggccaccuucaagcugcgcccgauguucgccgugggcauccucuuccggcgccugaccagccgggagguccugcuccugaccaucgggcugucccucguggccagcgucgagcugcccaacucccuggaggagcucggcgacgggcuggcgaugggcaucaugaugcugaagcuccugacggaguuccagccccaccagcuguggaccacccuccugagccugaccuucauccgcacgacccucucccuggacuacgccuggaagaccaccgccauggcccugagcaucgugucccucuucccccugugccugagcacgaccucccagaagaccaccuggcucccggugcugcugggcagcuucgggugcaagccccucaccauguacuucaucacggagaacaagaucuggggccggaaguccuggcccaucaacgaggggaucauggcgaucggcaucgucagcauccugcuguccagccuccugaagaacgacgugccccuggccgggccgcucaucgccggcggcaugcugaucgccugcuacgugaucagcggguccagcgccgaccugucccucgagaaggcggccgaggucagcugggagcaggaggccgagcacuccggcaccagccacaacauccugguggaggugcgcgacgacgggaccaugcggaucaaggacgaggagaaggacgacacccugacgauccuccugaaggccacccugcucgccgucuccggcguguaccccaugagcauccccgcgacccuguucgugugguacuucuggcagaagaagaagcagcgcuccgggguccugugggacacccccagcccgcccgagguggagcgggccgugcucgacgacggcaucuaccgcauccugcagcggggccugcuggggcgcucccaggucggcguggggguguuccaggacggcgucuuccacacgauguggcacgugacccgcggggccgugcucauguaccagggcaagcgccuggagcccagcugggccuccgucaagaaggaccugaucagcuacggcgggggcuggcgguuccagggguccuggaacaccggcgaggagguccaggugaucgccgucgagcccgggaagaacccgaagaacgugcagaccacgcccggcaccuucaagacccccgagggcgaggugggggcgaucgcccucgacuucaagcccggcaccagcggguccccgaucgucaaccgcgagggcaagaucgugggccuguacgggaacggcguggucacgaccagcgggaccuacguguccgccaucgcccaggccaaggcgagccaggagggcccccugcccgagaucgaggacgagguguucaagaagcggaaccucaccaucauggaccugcacccggggagcggcaagacgcgccgguaccugcccgccaucguccgcgaggccaucaagcgcaagcuccggacccugauccuggcccccacccgcgugguggcguccgagauggccgaggcccucaagggcaugcccauccgguaccagaccacggccgucaagagcgagcacaccgggcgcgagaucguggaccugaugugccacgccaccuucaccaugcggcugcucuccccggugcgcguccccaacuacaacaugaucaucauggacgaggcgcacuucacggaccccgccagcaucgccgcccggggcuacaucuccacccgcguggggaugggcgaggccgcggccaucuucaugaccgccacgccgcccgggagcguggaggccuucccccaguccaacgccgucauccaggacgaggagcgggacauccccgagcgcagcuggaacuccggcuacgacuggaucacggacuuccccggcaagaccgugugguucgugcccagcaucaaguccgggaacgacaucgcgaacugccugcggaagaacggcaagcgcgucauccagcugagccggaagaccuucgacaccgaguaccagaagacgaagaacaacgacugggacuacguggugaccaccgacaucuccgagaugggggccaacuuccgcgccgaccgggucaucgacccccgccggugccucaagcccgugauccugaaggacggccccgagcgcgugauccuggccgggccgaugcccgucaccguggcgagcgccgcccagcggcgcggccgcaucggccggaaccagaacaaggagggggaccaguacgucuacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucguggagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcgcgcaccuacuccgacccgcuggcccuccgggaguucaaggaguucgccgccgggcgccggagcgucagcggcgaccugauccuggagaucggcaagcucccccagcaccugacgcugcgcgcccagaacgcgcucgacaaccuggugaugcugcacaacuccgagcagggcgggaaggccuaccggcacgccauggaggagcuccccgacaccaucgagacccugaugcugcucgcccugaucgcggugcugaccgggggcgucacccucuucuuccugagcgggaagggccugggcaagaccuccaucgggcuccugugcgugaccgccagcuccgcccugcucuggauggccagcguggagccccacuggaucgccgcguccaucauccuggaguucuuccugaugguccuccugaucccggagcccgaccgccagcggacgccccaggacaaccagcuggccuacguggugaucggccuccuguucaugauccugacggucgccgccaacgagauggggcuccuggagaccaccaagcgcgaccugggcaucgggcacguggccgcggagaaccaccagcacgccaccaugcucgacguggaccugcgcccggccagcgccuggacgcuguacgccgucgcgaccaccgugaucacccccaugaugcggcacacgaucgagaacaccaccgccaacaucucccucaccgccaucgccaaccaggccgcgauccugaugggccuggacaagggcuggcccaucagcaagauggacaucggggugccccuccuggcccugggcugcuacucccaggucaacccgcucacgcugaccgccgccgugcugaugcucguggcgcacuacgccaucaucgggcccggccugcaggccaaggccacccgcgaggcccagaagcggaccgcggccgggaucaugaagaaccccacggucgacggcaucguggccaucgaccuggaccccguggucuacgacgccaaguucgagaagcagcucggccagaucaugcugcugauccucugcaccagccagauccugcugaugcgcaccaccugggcccucugcgaguccaucacgcuggcgaccgggccgcugaccacccucugggagggcagccccgggaaguucuggaacacgaccaucgccguguccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagcccgaguucaacacguacaagcggagcggcaucauggagguggaccgcagcgaggccaaggaggggcugaagcggggcgagaccaccaagcacgccgucucccgcgggaccgcgaagcuccggugguucguggagcgcaaccuggugaagcccgagggcaaggucaucgaccugggcugcgggcggggcggguggagcuacuacugcgccggccugaagaaggugaccgaggugaagggguacacgaagggcggcccggggcacgaggagcccauccccauggccaccuacggcuggaaccucgucaagcugcacuccgggaaggacguguucuucaugcccccggagaagugcgacacccugcucugcgacaucggcgagagcucccccaaccccaccaucgaggaggggcgcacgcugcgggugcugaagauggucgagcccuggcuccgcggcaaccaguucugcaucaagauccugaacccguacaugcccagcgugguggagacccuggagcagaugcagcggaagcacggcgggaugcucguccgcaacccccugucccgcaacagcacccacgagauguacuggguguccugcggcaccgggaacaucgugagcgccgucaacaugacgucccggaugcugcucaaccgcuucaccauggcccaccggaagcccaccuacgagcgcgacguggaccugggcgcgggcacccggcacguggccgucgagccggagguggccaaccuggacaucaucgggcagcgcaucgagaacaucaagaacgagcacaagagcacguggcacuacgacgaggacaaccccuacaagaccugggccuaccacggcuccuacgaggugaagcccagcggguccgccagcuccauggucaacggcgugguccggcuccugaccaagcccugggacgugaucccgauggugacccagaucgcgaugacggacaccacccccuucgggcagcagcgcgucuucaaggagaagguggacacccggacgccccgcgccaagcggggcaccacccagaucauggaggugaccgccaaguggcuguggggcuuccucagccgcaacaagaagccgcggaucugcacgcgcgaggaguucacccggaagguccgcuccaacgccgccaucggggcgguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacaccgcggggugggacacgcgcaucaccgaggacgaccugcagaacgaggccaagaucaccgacaucauggagcccgagcacgcccuccuggccaccuccaucuucaagcugacguaccagaacaagguggugcggguccagcgccccgccaagaacggcaccgugauggacgugaucagccggcgcgaccagcggggguccggccaggucggcaccuacgggcucaacaccuucacgaacauggaggugcagcugauccgccagauggagagcgagggcaucuuccugccguccgagcucgagacccccaaccuggcggagcgggugcuggacuggcucgagaagcacggggccgagcgccugaagcggauggccaucagcggcgacgacugcgucgugaagcccaucgacgaccgcuucgccaccgcccugaccgcgcucaacgacauggggaaggugcggaaggacaucccccagugggagccguccaagggcuggaacgacuggcagcagguccccuucugcagccaccacuuccaccagcugaucaugaaggacggccgcgagaucguggugcccugccggaaccaggacgagcuggucgggcgcgcccgggugucccagggcgccggguggagccuccgcgagaccgccugccugggcaaguccuacgcccagauguggcagcugauguacuuccaccggcgcgaccuccgccuggcggccaacgccaucugcagcgccgugcccgucgacugggugccgacgucccggaccaccuggagcauccacgcgcaccaccaguggaugaccacggaggacaugcugagcguguggaaccgcgucuggaucgaggagaaccccuggauggaggacaagacccacguguccagcugggaggaggugcccuaccucgggaagcgggaggaccaguggugcggcucccugaucggccugaccgcccgcgccaccugggccacgaacauccaggucgccaucaaccaggugcggcgccucaucgggaacgagagcuaccuggacuacaugaccuccaugaagcgguucaagaacgagagcgaccccgagggcgcgcugugguga

SEQ ID NO: 8174 - RNA, 9879 nt, Artificial Sequence
  derived and/or modified CDS sequence (opt1) from DENV-1__KF973474__SS-prME
agcgugaccaugcuccucaugcugcugcccaccgcccucgccuuccaccugaccacccgcggcggggagccgcacaugaucgugagcaagcacgagcggggcaagagccuccuguucaagaccagcaccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagacgggcgagcaccggcgcgacaagcgguccguggcccuggcgccccacgugggccuggggcucgagacccgcaccgagaccuggaugagcuccgagggcgccuggaagcagauccagcgggucgagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacgcucguggaccggggcugggggaacggcugcgggcuguucggcaaggggagccugcugaccugcgccaaguucaagugcgugaccaagcuggagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcucaccgacuacggggcccuggcccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcaccuccuacgucaugugcaccgggagcuucaagcuggagaaggagguggcggagacgcagcacggcaccgugcucguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcguguucaccuccguggggaagcugguccaccagguguucggcaccgccuacgggguccucuucagcggcgucuccuggacgaugaagaucgggaucggcauccugcugaccuggcucggccugaacagccgcuccaccagccuguccaugaccugcaucgccguggggauggugacgcucuaccugggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccucagcgcggccaucggcaaggccugggaggagggggugugcggcauccgguccgccacccgccuggagaacaucauguggaagcagaucagcaacgagcugaaccacauccuccuggagaacgacaugaaguucacggucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaccuggcccaagagccacacccugugguccaacggcguccuggagagcgagaugaucauccccaagaucuacgggggcccgaucucccagcacaacuaccgccccggguacuucacccagacggccggccccuggcaccucgggaagcuggagcuggacuucgaccucugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagcuucucccuggggauccucugcgucagcaucaugaucgaggaggugaugcgcucccgguggagccgcaagaugcugaugacgggcacccuggccguguuccuccugcugaucauggggcagcucaccuggaacgaccugauccgccugugcaucauggucggcgccaacgcguccgaccggauggggaugggcaccacguaccucgcccugauggccaccuucaagcugcgcccgauguucgccgugggcauccucuuccggcgccugaccagccgggaggugcugcuccugaccaucgggcugucccucgucgccagcguggagcugcccaacucccuggaggagcucggcgacgggcuggcgaugggcaucaugaugcugaagcuccugacggaguuccagccccaccagcuguggaccacccuccugagccugaccuucaucaagacgacccucucccuggacuacgccuggaagaccaccgccauggcccugagcaucgucucccucuucccccugugccugagcacgaccucccagaagaccaccuggcucccggugcugcugggcagcuucgggugcaagccccucaccauguaccugaucacggagaacaagaucuggggccgcaaguccuggcccaucaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugcggaucaaggacgaggagaaggacgacacccucacgauccugcugaaggccacccuccuggccguguccggcgucuaccccaugagcauccccgcgacccuguucgugugguacuucuggcagaagaagaagcagcgcuccggggugcucugggacacccccagcccgcccgaggucgagcgggccgugcuggacgacggcaucuaccgcauccugcagcggggccugcucgggcgcucccaggugggcgucgggguguuccaggacggcguguuccacacgauguggcacgucacccgcggggccgugcugauguaccagggcaagcgccuggagcccagcugggccuccgugaagaaggaccucaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgcgagggcaagaucgucggccuguacgggaacggcguggugacgaccagcgggaccuacgucuccgccaucgcccaggccaaggcgagccaggagggcccccuccccgagaucgaggacgagguguucaagaagcggaaccugaccaucauggaccugcacccggggagcggcaagacgcgccgguaccuccccgccaucgugcgcgaggccaucaagcggaagcugcgcacccugauccucgcccccacccgcgucguggcguccgagauggccgaggcccugaagggcaugcccgugcgguaccagaccacggccgucaagagcgagcacaccgggcgcgagaucguggaccugaugugccacgccaccuucaccaugcggcuccuguccccggugcgcguccccaacuacaacaugaucaucauggacgaggcgcacuucacggaccccgccagcaucgccgcccggggcuacaucuccacccgcguggggaugggcgaggccgcggccaucuucaugaccgccacgccgcccgggagcguggaggccuucccccaguccaacgccgucauccaggacgaggagcgggacauccccgagcgcagcuggaacuccggcuacgacuggaucacggacuuccccggcaagaccgugugguucgugcccagcaucaaguccgggaacgacaucgcgaacugccugcggaagaacggcaagcgcgucauccagcucagccggaagaccuucgacaccgaguaccagaagacgaagaacaacgacugggacuacguggugaccaccgacaucuccgagaugggggccaacuuccgcgccgaccgggucaucgacccccgccggugccugaagcccgugauccugaaggacggccccgagcgcgugauccucgccgggccgaugcccgucaccguggcgagcgccgcccagcggcgcggccggaucggccgcaaccagaacaaggagggggaccaguacgucuacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccggcugcgcggggaggcccggaagaccuucguggagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcgcgcaccuacuccgacccgcucgcccugcgggaguucaaggaguucgccgccgggcgccggagcgucagcggcgaccugauccucgagaucggcaagcugccccagcaccugacgcuccgcgcccagaacgcgcuggacaaccuggugaugcuccacaacuccgagcagggcgggaaggccuaccggcacgccauggaggagcugcccgacaccaucgagacccugaugcuccuggcccugaucgcggugcucaccgggggcgucacgcuguucuuccugagcgggaagggccucggcaagaccuccaucgggcugcugugcgugaccgccagcuccgcccuccuguggauggccagcguggagccccacuggaucgccgcguccaucauccuggaguucuuccucaugguccugcugaucccggagcccgaccgccagcggacgccccaggacaaccagcucgccuacguggugaucggccugcuguucaugauccucacggucgccgccaacgagauggggcugcuggagaccaccaagcgcgaccucggcaucgggcacguggccgcggagaaccaccagcacgccaccaugcuggacguggaccugcggccggccagcgccuggacgcucuacgccgucgcgaccaccgugaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggucaacccgcugacgcugaccgccgccgugcucaugcugguggcgcacuacgccaucaucgggcccggccugcaggccaaggccacccgcgaggcccagaagcggaccgcggccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccguguccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagcccgaguucaacacguacaagcggagcggcaucauggagguggaccgcagcgaggccaaggaggggcucaagcggggcgagaccaccaagcacgccgucucccgcgggaccgcgaagcugcggugguucguggagcgcaaccuggugaagcccgagggcaaggucaucgaccugggcugcgggcggggcggguggagcuacuacugcgccggccucaagaaggugaccgaggugaagggguacacgaagggcggcccggggcacgaggagcccauccccauggccaccuacggcuggaaccuggucaagcugcacuccgggaaggacguguucuucaugcccccggagaagugcgacacccuccugugcgacaucggcgagagcucccccaaccccaccaucgaggaggggcgcacgcugcgggugcucaagauggucgagcccuggcugcgcggcaaccaguucugcaucaagauccugaacccguacaugcccagcgugguggagacccucgagcagaugcagcggaagcacggcgggaugcugguccgcaacccccugucccggaacagcacccacgagauguacuggguguccugcggcaccgggaacaucgugagcgccgucaacaugacgucccgcaugcuccugaaccgcuucaccauggcccaccggaagcccaccuacgagcgcgacguggaccugggcgcgggcacccggcacgugacggucgagccggagguggccaaccucgacaucaucgggcagcgcaucgagaacaucaagaacgagcacaagagcaccuggcacuacgacgaggacaaccccuacaagaccugggccuaccacggcuccuacgaggugaagcccagcggguccgccagcuccauggucaacggcgugguccggcugcugaccaagcccugggacgugaucccgauggugacgcagaucgccaugaccgacaccacccccuucgggcagcagcgcgucuucaaggagaagguggacacgcggacgccccgggcgaagcggggcaccacccagaucauggaggugacggccaaguggcucuggggcuuccugagccgcaacaagaagccgcggaucugcacccgcgaggaguucacccggaagguccgcuccaacgccgccaucggggccguguucguggacgagaaccaguggaacagcgcgaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacacggccgggugggacacccgcaucaccgaggacgaccuccagaacgaggcgaagaucaccgacaucauggagcccgagcacgcccugcuggccacguccaucuucaagcucaccuaccagaacaagguggugcggguccagcgccccgccaagaacggcaccgugauggacgugaucagccggcgcgaccagcggggguccggccaggucggcaccuacgggcugaacacguucaccaacauggaggugcagcugauccgccagauggagagcgagggcaucuuccucccguccgagcuggagacccccaaccuggccgagcgggugcucgacuggcuggagaagcacggggcggagcgccugaagcggauggccaucagcggcgacgacugcgucgugaagcccaucgacgaccgcuucgccaccgcccucaccgcccugaacgacauggggaaggugcggaaggacaucccccagugggagccguccaagggcuggaacgacuggcagcagguccccuucugcagccaccacuuccaccagcugaucaugaaggacggccgcgagaucguggugcccugccggaaccaggacgagcucgucgggcgcgcgcgggugucccagggcgccggguggagccugcgcgagacggccugccugggcaaguccuacgcccagauguggcagcucauguacuuccaccggcgcgaccugcggcuggccgcgaacgccaucugcagcgccgugcccgucgacugggugccgaccucccgcaccaccuggagcauccacgcccaccaccaguggaugacgaccgaggacaugcucagcguguggaaccgcgucuggaucgaggagaaccccuggauggaggacaagacccacguguccagcugggaggaggugcccuaccuggggaagcgggaggaccaguggugcggcucccugaucggccucaccgcgcgcgccacgugggccaccaacauccaggucgccaucaaccaggugcggcgccugaucgggaacgagaacuaccuggacuacaugaccagcaugaagcgguucaagaacgaguccgaccccgagggcgcccucugguga

SEQ ID NO: 8175 - RNA, 9879 nt, Artificial Sequence
  derived and/or modified CDS sequence (opt1) from DENV-1__KF973475__SS-prME
agcgugaccaugcugcucaugcugaugcccaccgcccuggccuuccaccucacgacccgcggcggggagccgcacaugaucgucuccaagcacgagcggggcaaggcgcugcuguucaagaccagcaccggggugaacaugugcacgcucaucgccauggaccugggcgagcugugcgaggacaccaugaccuacaagugcccccgcaucaccgaggccgagcccgacgacguggacugcuggugcaacgccacggacaccugggucaccuacgggaccugcucccagacgggcgagcaccggcgcgacaagcggagcguggcccucgcgccccacgugggccuggggcuggagacccgcaccgagaccuggauguccagcgagggcgccuggaagcagauccagcgggucgagacgugggcccuccgccacccgggguucaccgugaucgcccuguuccuggcgcacgccaucggcaccuccaucacccagaaggggaucaucuucauccuccugaugcuggugacgcccagcauggccaugcggugcgucggcaucggcaaccgcgacuucguggaggggcucuccggcgccaccuggguggacgucgugcuggagcacgggagcugcgugaccaccauggccaagaacaagcccacgcuggacaucgagcuccugaagaccgaggucaccaaccccgcggugcugcggaagcucugcaucgaggccaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccuccugaccugcgccaaguucaagugcgugaccaagcuggagggcaagaucguccaguacgagaaccucaaguacagcgugaucgugaccguccacacgggcgaccagcaccagguggggaacgagaccaccgagcacggcaccaucgcgaccaucacgccccaggcccccaccuccgagauccagcugaccgacuacggggcccugacccucgacugcagcccccgcacgggccuggacuucaacgagaugguccugcucaccaugaaggagaaguccuggcuggugcacaagcagugguuccuggaccucccgcugcccuggaccagcggggccuccaccagccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaccagcuacgucaugugcacgggguccuucaagcuggagaaggagguggcggagacccagcacggcaccgugcugguccaggugaaguacgagggcaccgacgcccccugcaagauccccuucagcacgcaggacgagaagggggugacccagaacggccggcugaucaccgccaacccgaucgucaccgacaaggagaagcccgugaacaucgagacggagccccccuucggggaguccuacaucguggucggcgccggcgagaaggcgcucaagcugagcugguucaagaagggguccagcaucggcaagauguucgaggccaccgcccgcggggcccggcgcauggccauccugggcgacaccgcgugggacuucggguccaucggcggcguguucaccagcguggggaagcucguccaccagguguucggcacggccuacggggugcuguucuccggcgucagcuggaccaugaagaucgggaucggcauccugcucaccuggcugggccugaacucccgcagcaccucccucagcaugacgugcaucgccguggggauggugacccuguaccugggcgucauggugcaggccgacuccgggugcgugaucaacuggaagggccgggagcucaagugcgggagcggcaucuucgucaccaacgaggugcacaccuggaccgagcaguacaaguuccaggccgacuccccgaagcgccugagcgcggccaucggcaaggccugggaggagggggugugcggcauccggagcgccacgcgccuggagaacaucauguggaagcagaucuccaacgagcucaaccacauccugcuggagaacgggaugaaguucaccgucguggugggcgacgccaacgggauccucgcgcagggcaagaagaugauccggccccagcccauggagcacaaguacagcuggaaguccuggggcaaggccaagaucaucggggccgacauccagaacaccaccuucaucaucgacggccccgacacgccggagugccccgacgaccagcgcgccuggaacaucugggaggucgaggacuacggguucggcaucuucaccaccaacaucuggcugaagcugcgggacagcuacacccagaugugcgaccaccgccucauguccgcggccaucaaggacagcaaggccgugcacgccgacaugggcuacuggaucgaguccgagaagaacgagacguggaagcuggcccgggcgagcuucaucgaggugaagaccugcaccuggcccaagucccacacccuguggagcaacgggguccucgaguccgagaugaucauccccaagaucuacggcgggccgaucagccagcacaacuaccgccccggcuacuucacgcagaccgccgggcccuggcaccugggcaagcuggagcucgacuucgaccugugcgagggcaccaccgugguggucgacgagcacugcgggaaccggggcccgucccugcgcacgaccaccgugaccgggaagaucauccacgaguggugcugccggagcugcacgcuccccccccugcgcuuccggggcgaggacgggugcugguacggcauggagauccgccccgugaaggagaaggaggagaaccugguccgguccauggugagcgccggcuccggggagguggacagcuucagccucggcauccugugcgucuccaucaugaucgaggaggugaugcgcagccgguggucccgcaagaugcugaugaccgggacccucgccguguuccugcugcucaucaugggccagcugaccuggaacgaccugauccgccucugcaucauggucggggccaacgcgagcgaccggaugggcaugggcacgaccuaccuggcccugauggccaccuucaagaugcgcccgauguucgccguggggauccucuuccggcgccugaccucccgggaggugcugcuccugacgaucggccugagccucgucgccuccguggagcugcccaacagccuggaggagcucggggacggccuggcgaugggcaucaugaugcugaagcuccugaccgaguuccagccccaccagcuguggaccacccuccugucccugacguucaucaagaccacccucagccuggacuacgccuggaagaccacggccauggcccuguccaucgucagccucuucccccugugccuguccaccaccagccagaagaccaccuggcucccggugcugcugggguccuucggcugcaagccccucacgauguuccugaucaccgagaacaagaucugggggcgcaagagcuggcccaucaacgagggcaucauggcgaucgggaucguguccauccugcucagcucccugcugaagaacgacgucccccucgccggcccgcugaucgccggcgggaugcugaucgccugcuacgugaucagcggcagcuccgccgaccucagccuggagaaggcggccgagguguccugggagcaggaggccgagcacagcgggaccucccacaacauccuggucgaggugcaggacgacggcaccaugcggaucaaggacgaggagaaggacgacacgcucaccauccugcugaaggccacccuccuggccgugagcggggucuaccccauguccauccccgcgacccuguucgugugguacuucuggcagaagaagaagcagcgcagcggcgugcucugggacacgcccuccccgcccgaggucgagcgggccgugcuggacgacggcaucuaccgcauccugcagcgggggcuccugggccgcagccaggugggggucggcguguuccaggacgggguguuccacaccauguggcacgucacccggggcgccgugcugauguaccagggcaagcgccuggagcccuccugggccagcgugaagaaggaccucaucuccuacgggggcggguggcgguuccagggcagcuggaacaccggggaggagguccaggugaucgccguggagcccggcaagaacccgaagaacguccagacgacccccggcaccuucaagaccuccgagggggaggugggcgcgaucgcccuggacuucaagcccgggacgagcggcucccccaucgugaaccgcgagggcaagaucgucgggcuguacggcaacgggguggugaccaccagcggcaccuacgucuccgccaucgcccaggccaagacgagccaggaggggccgcuccccgagaucgaggacgagguguucaagaagcggaaccugaccaucauggaccugcaccccggcagcggcaagacccgccgguaccucccggcgaucgugcgcgaggccaucaagcggaagcugcgcacccugauccucgcccccacgcgcgucguggccuccgagauggcggaggcccugaaggggaugcccauccgguaccagaccaccgccgugaagagcgagcacaccggccgcgagaucgucgaccugaugugccacgccacguucaccaugcggcuccugucccccgugcgcgugccgaacuacaacaugaucaucauggacgaggcccacuucaccgaccccgcgagcaucgccgcccggggguacaucuccacccgcgucggcaugggggaggccgccgcgaucuucaugacggccaccccccccggcagcguggaggccuucccgcaguccaacgccgugauccaggacgaggagcgggacauccccgagcgcagcuggaacuccggcuacgacuggaucaccgacuuccccgggaagaccgucugguucgugcccagcaucaaguccggcaacgacaucgccaacugccugcggaagaacgggaagcgcgugauccagcucagccggaagacguucgacaccgaguaccagaagaccaagaacaacgacugggacuacgucgugaccacggacaucuccgagaugggcgcgaacuuccgcgccgaccgggugaucgacccgcgccggugccugaagcccgucauccugaaggacgggcccgagcgcgugauccucgccggccccaugccggugaccgucgccagcgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccggcugcgcggcgaggcccggaagaccuucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcgcugcgggaguucaaggaguucgccgccggccgccggagcgugagcggcgaccugauccucgagaucgggaagcugccgcagcaccugacccuccgcgcccagaacgcccuggacaaccuggucaugcuccacaacuccgagcagggcgggaaggcguaccggcacgccauggaggagcugcccgacaccaucgagacgcugaugcuccuggcccugaucgccgugcucaccggcggggugacccuguucuuccugagcggcaagggccucgggaagaccuccaucggccugcugugcgucacggcgagcuccgcccuccuguggauggccagcguggagccccacuggaucgccgccuccaucauccuggaguucuuccucauggugcugcugauccccgagccggaccgccagcggaccccccaggacaaccagcucgcguacgucgugaucgggcugcuguucaugauccucaccguggccgccaacgagaugggccugcuggagaccacgaagcgcgaccucgggaucggccacgucgccgccgagaaccaccagcacgcgaccaugcuggacguggaccugcggcccgccagcgccuggacccucuacgccguggccaccacggucaucaccccgaugaugcgccacaccaucgagaacaccacggcgaacaucucccugaccgccaucgccaaccaggccgccauccugaugggccucgacaagggguggcccaucagcaagauggacaucggcgugccccugcuggcgcucgggugcuacucccaggugaacccccugacccugaccgccgccguccucaugcugguggcccacuacgcgaucaucggcccggggcugcaggccaaggccacgcgcgaggcccagaagcggaccgccgcgggcaucaugaagaaccccaccguggacggcaucgucgccaucgaccucgaccccgugguguacgacgccaaguucgagaagcagcuggggcagaucaugcugcucauccugugcaccagccagauccugcucaugcgcacgaccugggcccugugcgaguccaucacccuggccaccggcccccucacgacccugugggaggggagcccgggcaaguucuggaacaccaccaucgcggucuccauggccaacaucuuccggggcagcuaccuggccggggccggccucgccuucucccugaugaagagccuggggggcgggcgccggggcacgggcgcgcagggggagacccucggcgagaaguggaagcgccagcugaaccagcuguccaagcccgaguucaacaccuacaagcggagcgggaucauggagguggaccgcagcgaggccaaggagggccucaagcggggggagaccaccaagcacgccgugucccgcggcacggccaagcugcggugguucgucgagcgcaaccuggugaagcccgagggcaaggugaucgaccucgggugcggccgggggggcuggagcuacuacugcgcggggcugaagaaggucaccgaggugaagggcuacaccaagggcgggcccggccacgaggagccgauccccauggccaccuacggguggaaccuggugaagcugcacuccggcaaggacgucuucuucaugccccccgagaagugcgacacgcuccugugcgacaucggggagagcuccccgaaccccaccaucgaggagggccgcacccugcgggugcucaagaugguggagcccuggcugcgcggcaaccaguucugcaucaagauccugaaccccuacaugccgagcgucguggagacccucgagcagaugcagcggaagcacgggggcaugcuggugcgcaacccccugucccggaacagcacgcacgagauguacugggucuccugcgggaccggcaacaucgugagcgccgugaacaugaccucccgcaugcuccugaaccgcuucaccauggcccaccggaagcccacguacgagcgcgacgucgaccugggcgccgggacccggcacguggcgguggagcccgaggucgccaaccucgacaucaucggccagcgcaucgagaacaucaagaacgagcacaagagcaccuggcacuacgacgaggacaacccguacaagaccugggccuaccacggguccuacgaggugaagcccagcggcuccgccagcuccauggugaacggggucgugcggcugcugacgaagcccugggacgucauccccauggugacccagaucgccaugaccgacaccacgccguucggccagcagcgcguguucaaggagaaggucgacacccggaccccccgcgcgaagcggggcaccacgcagaucauggaggugaccgccaaguggcucuggggguuccugagccgcaacaagaagccccggaucugcacccgcgaggaguucacccggaaggugcgcuccaacgccgccaucggcgccgucuucguggacgagaaccaguggaacagcgcgaaggaggccguggaggacgagcgguucugggaccugguccaccgcgagcgggagcuccacaagcaggggaagugcgccacgugcguguacaacaugaugggcaagcgcgagaagaagcugggggaguucggcaaggccaagggcagccgggcgaucugguacauguggcugggggcccgcuuccucgaguucgaggcccugggcuucaugaacgaggaccacugguucucccgggagaacagccuguccgggguggagggcgaggggcuccacaagcugggcuacauccugcgcgacaucagcaagaucccgggcgggaacauguacgccgacgacaccgccggcugggacacccgcaucaccgaggacgaccuccagaacgaggcgaagaucacggacaucauggagcccgagcacgcccugcuggccaccuccaucuucaagcucaccuaccagaacaaggucgugcgggugcagcgccccgccaagaacgggaccgucauggacgugaucagccggcgcgaccagcggggcuccggccagguggggacguacggccugaacaccuucaccaacauggagguccagcugauccgccagauggagagcgaggggaucuuccuccccuccgagcuggagaccccgaaccuggccgagcgggugcucgacuggcuggagaagcacggcgcggagcgccugaagcggauggccaucagcggggacgacugcguggucaagcccaucgacgaccgcuucgccaccgcccucacggcccugaacgacaugggcaaggugcggaaggacaucccccagugggagcccuccaagggcuggaacgacuggcagcaggugccguucugcagccaccacuuccaccagcugaucaugaaggacgggcgcgagaucgucgugcccugccggaaccaggacgagcucgugggccgcgcgcgggucucccagggggccggcuggagccugcgcgagaccgccugccuggggaaguccuacgcccagauguggcagcucauguacuuccaccggcgcgaccugcggcuggccgcgaacgccaucugcagcgccgugcccguggacuggguccccaccucccgcaccacguggagcauccacgcccaccaccaguggaugaccaccgaggacaugcucagcguguggaaccgcguguggaucgaggagaacccguggauggaggacaagacccacgucuccagcugggaggaggugcccuaccugggcaagcgggaggaccaguggugcggcucccugaucgggcucacggcgcgcgccaccugggccaccaacauccagguggccaucaaccagguccggcgccugaucggcaacgagaacuaccuggacuacaugaccagcaugaagcgguucaagaacgaguccgaccccgagggggcccucugguga

SEQ ID NO: 8176 - RNA, 9879 nt, Artificial Sequence
  derived and/or modified CDS sequence (opt1) from DENV-1__FJ898448__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacgcugaucgccauggaccugggcgagcucugcgacgacaccaugaccuacaagugcccccgcaucaccgagacggagcccgacgacguggacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcccuguuccucgcccacgccaucggcaccagcaucacgcagaaggggaucaucuucauccugcugaugcucgugacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacaccaacuucgugugccggcgcaccuucguggaccggggcugggggaacggcugcggccucuucggcaaggggagccugaucacgugcgcgaaguucaagugcgucacgaagcuggagggcaagaucgugcaguacgagaaccucaaguacuccgugaucgucaccgugcacaccggcgaccagcaccaggucgggaacgagaccaccgagcacggcacgaucgccaccaucacgccccaggcccccaccagcgagauccagcugacggacuacggggcccugacccucgacugcagcccccggaccggccuggacuucaacgagauggugcugcucaccaugaaggagaaguccuggcuggugcacaagcagugguuccuggaccucccgcugcccuggacguccggggccagcaccagccaggagaccuggaaccggcaggaccugcucgucaccuucaagacggcgcacgccaagaagcaggagguggugguccugggcucccaggagggcgccaugcacaccgcccugaccggggccaccgagauccagacgagcggcaccaccaccaucuucgcggggcaccucaagugccgccugaagauggacaagcugacgcucaagggcaucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcuggugaccgccaacccgaucgugaccgacaaggagaagcccgucaacaucgaggccgagccgcccuucggggaguccuacaucguggugggcgcgggcgagaaggcccucaagcugagcugguucaagaagggguccagcaucggcaagauguucgaggccacggcccgcggggcgcggcgcauggccauccugggcgacaccgccugggacuucggguccaucggcggcgucuucaccagcguggggaagcucgugcaccagaucuucggcaccgccuacgggguccuguucuccggcgugagcuggacgaugaagaucgggaucggcauccugcucaccuggcugggccugaacucccgcagcaccucccucagcaugaccugcaucgccguggggauggucacgcuguaccugggcgugauggugcaggcggacuccgggugcgucaucaacuggaagggccgggagcucaagugcgggagcggcaucuucgugaccaacgaggugcacaccuggaccgagcaguacaaguuccaggccgacagcccgaagcgccuguccgccgccaucggcaaggccugggaggagggggucugcggcauccggagcgcgacccgccuggagaacaucauguggaagcagaucuccaacgagcucaaccacauccugcuggagaacgacaugaaguucacggugguggucggggacgugagcggcauccucgcccaggggaagaagaccauccggccccagcccauggagcacaaguacuccuggaaguccuggggcaaggccaagaucaucggcgccgacgugcagaacaccaccuucaucaucgacgggcccaacacgccggagugccccgacgaccagcgcgccuggaacaucugggaggucgaggacuacggcuucgggaucuucaccaccaacaucuggcugaagcugcgggacuccuacacccaggugugcgaccaccgccucaugagcgcggccaucaaggacuccaaggccgugcacgccgacaugggcuacuggaucgagagcgagaagaacgagacguggaagcuggcgcgggccuccuucaucgaggucaagaccugcguguggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccugcgcuucaagggggaggacggcugcugguacgggauggagauccggcccgugaaggagaaggaggagaaccuggucaagagcauggucagcgccggcuccggcgagguggacagcuucucccucgggcugcugugcaucagcaucaugaucgaggaggugaugcgcucccgguggagccgcaagaugcucaugacgggcacccuggucguguuccugcuccugacccuggggcagcucaccuggaacgaccugauccggcugugcaucauggucggcgccaacgcguccgacaacauggggaugggcacgaccuaccucgcccugauggccaccuuccgcaugcgcccgauguucgccgugggccuccucuuccggcgccugaccagccgggaggugcugcuccugacggucgggcugucccucguggccagcguggagcugcccaacucccuggacgagcucggcgacgggcuggcgaugggcaucaugauccugaagcuccugaccgacuuccagagccaccagcugugggccacccuccugucccugaccuucgucaagacgacccucagccugcacuacgccuggaagaccauggccaugauccuguccaucgugagccuccugccccugugccucuccaccacgagccagaagaccaccuggcugcccgugcugcucggcucccuggggugcaagccgcugaccauguuccucaucaccgagaacaagaucuggggccgcaagagcuggccccugaacgaggggaucauggccgucggcaucgugagcauccugcucuccagccugcugaagaacgacgugccccucgcggggccccugaucgccggcggcaugcugaucgccugcuacgucaucuccgggagcuccgccgaccucagccuggagaaggcggccaagguguccugggaggaggaggccgagcacagcggcgccucccacaacauccugguggagauccaggacgacgggacgaugaagaucaaggacgaggagcgggacgacaccaucaccauccuccugaaggccacccugcucgcgaucagcggcgucuacccgauguccauccccgccacgcuguucguguggcacuucuggcagaagaagaagcagcgcagcggggugcugugggacacccccagcccgcccgaggucgagaaggccgugcuggacgacggcaucuaccggauccuccagcgcggccugcuggggcggagccaggugggcgucgggguguuccaggagggcguguuccacaccauguggcacgucacccgcggggccgugcucauguaccagggcaagcggcuggagcccuccugggccagcgugaagaaggaccugaucuccuacggcgggggcuggcgcuuccaggggagcuggaacacgggcgaggagguccaggugaucgcgguggagcccgggaagaaccccaagaacguccagaccgcccccggcaccuucaagaccuccgagggcgaggugggggccaucgcccucgacuucaagcccggcacgagcgggagccccaucgugaaccgggagggcaagaucgucggccuguacgggaacggcguggugaccaccuccgggaccuacgucagcgccaucgcgcaggccaaggccucccaggagggcccccugccggagaucgaggacgagguguuccgcaagcggaaccucacgaucauggaccugcaccccgggagcggcaagacccgccgguaccugcccgccaucgugcgcgaggccaucaagcggaagcuccgcacccugguccuggcgccgacccgggugguggccuccgagauggccgaggcccucaagggcaugcccauccgcuaccagacgaccgcggucaagagcgagcacaccgggaaggagaucguggaccugaugugccacgccaccuucacgaugcgccugcucucccccgugcggguccccaacuacaacaugaucaucauggacgaggcccacuucaccgacccggccagcaucgccgcgcgcggcuacaucuccacccggguggggaugggcgaggccgccgccaucuucaugaccgccacgccgcccgggagcguggaggcguucccccaguccaacgccgucauccaggacgaggagaaggacaucccggagcgcagcuggaacuccggcuacgacuggaucaccgacuuccccggcaagaccgugugguucgugcccagcaucaaguccgggaacgacaucgccaacugccugcggaagaacggcaagcgcgucauccagcugagccggaagaccuucgacacggaguaccagaagaccaagaacaacgacugggacuacguggucaccaccgacaucuccgagaugggggccaacuuccgcgccgaccgggugaucgacccccgccggugccucaagccggugauccugaaggacggccccgagcgcgucauccuggcggggcccaugcccgugacgguggccagcgccgcccagcggcgcggccggaucggccgcaaccagaacaaggagggggaccaguacaucuacaugggccagccgcucaacaacgacgaggaccacgcgcacuggaccgaggccaagaugcugcuggacaacaucaacacccccgaggggaucauccccgcccucuucgagcccgagcgggagaaguccgccgccaucgacggcgaguaccgccugcgcggggaggcgcgcaagaccuucgucgagcugaugcgccggggcgaccucccgguguggcugagcuacaagguggccagcgagggcuuccaguacuccgaccgccgguggugcuucgacggggagcgcaacaaccagguccuggaggagaacauggacguggagaucuggacgaaggagggcgagcggaagaagcuccgcccccgguggcuggacgcccgcaccuacagcgacccccuggcccuccgggaguucaaggaguucgccgcggggcgccgguccgugagcggcgaccugauccuggagaucggcaagcucccccagcaccugacccagcgcgcccagaacgcccuggacaaccucgucaugcugcacaacuccgagcagggcgggaaggccuaccggcacgccauggaggagcugccggacaccaucgagaccaucaugcuccuggcgcugaucgccgugcucaccggcggggugacccuguucuuccugagcgggcgcgggcucggcaagaccuccaucgggcugcugugcgucaccagcuccagcgcccuccuguggauggccuccguggagccccacuggaucgcggccagcaucauccuggaguucuuccucauggugcugcugauccccgagcccgaccggcagcgcacgccgcaggacaaccagcucgccuacgucgugaucggccugcuguucaugauccucaccguggccgccaacgagauggggcugcuggagaccaccaagaaggaccucggcaucgggcacgcggccgccgagaaccaccaccacgccgccaugcuggacgucgaccugcaccccgcguccgccuggacgcucuacgccguggccaccaccaucaucacccccaugaugcggcacacgaucgagaacaccaccgccaacaucagccugaccgcgaucgccaaccaggccgccauccugaugggccucgacaagggcuggccgaucuccaagauggacaucggggugccccugcuggcccucggcugcuacagccaggucaacccccugacgcugaccgcggccgugcucaugcugguggcccacuacgccaucaucgggcccggccugcaggcgaaggccacccgcgaggcccagaagcggaccgccgccgggaucaugaagaacccgacggucgacggcaucguggcgaucgaccucgaccccguggucuacgacgccaaguucgagaagcagcugggccagaucaugcugcucauccugugcaccucccagauccugcucaugcgcaccaccugggcccugugcgagagcaucacgcuggccaccgggccccucaccacccugugggagggcucccccgggaaguucuggaacacgaccaucgccgugagcauggcgaacaucuuccggggcagcuaccuggccggcgccgggcucgccuucucccugaugaagucccugggcgggggccgccgcgggaccggcgcccagggcgagacccucggggagaaguggaagcggcagcugaaccagcuguccaagagcgaguucaacacguacaagcgcuccggcaucaucgagguggaccggagcgaggcgaaggaggggcucaagcgcggcgagaccaccaagcacgccgucucccgggggaccgccaagcugcgcugguucguggagcggaaccuggugaagccggagggcaaggucaucgaccugggcugcgggcgcggcggguggagcuacuacugcgccggccucaagaaggugacggaggugaagggguacaccaagggcggccccgggcacgaggagcccauccccauggcgaccuacggcuggaaccuggucaagcugcacuccgggaaggacguguucuucaucccgcccgagaagugcgacacccuccugugcgacaucggcgagagcucccccaaccccaccaucgaggaggggcggacgcugcgcgugcucaagauggucgagccguggcugcggggcaaccaguucugcaucaagauccugaaccccuacaugcccagcgugguggagacccucgagcagaugcagcgcaagcacggcgggaugcugguccggaacccccugucccgcaacagcacccacgagauguacuggguguccugcggcaccgggaacaucgugagcgccgucaacaugacgucccggaugcuccugaaccgcuucaccauggcccaccggaagccgaccuacgagcgcgacguggaccugggcgccggcacccggcacguggccgucgagcccgagguggcgaaccucgacaucaucgggcagcgcaucgagaacaucaagaacgagcacaagagcacguggcacuacgacgaggacaaccccuacaagaccugggccuaccacggcuccuacgaggucaagcccagcgggagcgccuccagcauggugaacggcgugguccgccugcugaccaagccgugggacgugauccccauggugacccagaucgccaugacggacaccacccccuucgggcagcagcgggucuucaaggagaagguggacacccgcacgcccaaggccaagcggggcaccgcgcagaucauggaggugaccgccaaguggcucuggggcuuccugucccgcaacaagaagccgcggaucugcacccgcgaggaguucacgcggaagguccgcagcaacgccgccaucggggccguguucguggacgagaaccaguggaacuccgcgaaggaggccgucgaggacgagcgguucugggaccuggugcgccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucacggaggacgaccuccagaacgaggcgaagaucaccgacaucauggagcccgagcacgcccugcuggccaccuccaucuucaagcucaccuaccagaacaagguggugcggguccagcgcccggccaagaacggcacggugauggacgugaucagccggcgcgaccagcgcggguccggccaggucggcaccuacgggcugaacaccuucaccaacauggaggcccagcugauccggcagauggagagcgagggcaucuucucccccagcgagcucgagacgcccaaccuggcggggcgcgugcuggacuggcucgagaagcacggcaccgagcggcugcgccggauggccaucuccggggacgacugcguggucaagcccaucgacgaccgcuucgccaccgcccugaccgcccucaacgacaugggcaaggugcggaaggacaucccgcagugggagcccagcaagggcuggaacgacuggcagcagguccccuucugcagccaccacuuccaccagcugaucaugaaggacgggcgcgagaucgucgugcccugccggaaccaggacgagcuggugggccgcgcgcgggucucccagggggccggcuggagccuccgcgagacggccugccuggggaaguccuacgcccagauguggcagcugauguacuuccaccggcgcgaccuccggcuggccgcgaacgccaucugcagcgccgugccgguggacuggguccccaccucccgcaccaccuggagcauccacgcccaccaccaguggaugaccacggaggacaugcuguccguguggaaccggguguggaucgaggagaaccccuggauggaggacaagacccacgucagcuccugggaggacgugcccuaccucggcaagcgcgaggaccaguggugcggcagccugaucgggcugaccgcgcgggccaccugggccacgaacauccagguggccaucaaccagguccgccgccucaucggcaacgagaacuaccuggacuacaugaccuccaugaagcgguucaagaacgagagcgacccggagggggcccugugguga

SEQ ID NO: 8177 - RNA, 9879 nt, Artificial Sequence
  derived and/or modified CDS sequence (opt1) from DENV-1__GQ868602__SS-prME
agcgugaccaugcugcucaugcugcugcccaccgcccucgccuuccaccugaccacccgcggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccggaucaccgagaccgagcccgacgacguggacugcuggugcaacgccaccgagaccugggugaccuacgggaccugcagccagaccggcgagcaccggcgcgacaagcgguccguggcccuggcgccccacgugggccuggggcucgagacccgcaccgagaccuggaugagcuccgagggcgcguggcggcagauccagaagguggagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacacgaacuucgucugccggcgcaccuucguggaccggggcugggggaacggcugcggccuguucggcaaggggagccugaucacgugcgccaaguucaagugcgugaccaagcuggagggcaagaucguccaguacgagaaccucaaguacuccgugaucgugacgguccacaccggcgaccagcaccagguggggaacgagaccaccgagcacggcaccacggccaccaucacgccccaggcccccaccagcgagauccagcugacggacuacggggcgcugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcccacgccaagaagcaggaggucguggugcugggcucccaggagggcgccaugcacaccgcgcugaccggggccaccgagauccagacgagcggcaccaccaccaucuucgccgggcaccucaagugccgccugaagauggacaagcugacgcucaagggcgucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcugaucaccgcgaacccgaucgugaccgacaaggagaagcccgugaacaucgaggccgagccgcccuucggggaguccuaccucgucgugggcgccggcgagaaggcccugaagcugagcugguucaagaagggguccagcaucggcaagauguucgaggcgacggcccgcggggcccggcgcauggccauccucggcgacaccgccugggacuucggguccaucggcggcguguucaccagcgucgggaagcugauccaccagaucuucggcaccgcguacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccuguccgccgcgaucggcaaggccugggaggagggggugugcggcauccggagcgccacccgccucgagaacaucauguggaagcagaucuccaacgagcugaaccacauccugcucgagaacgacaugaaguucacgguggucgugggggacgugaacggcguccuggcccaggggaagaagaugauccggccccagcccauggagcacaaguacagcuggaaguccuggggcaaggccaaggugaucggcgcggacgugcagaacaucaccuucaucaucgacgggcccaacaccccggagugccccgacgaccagcgcgccuggaacaucugggaggucgaggacuacggcuucgggaucuucaccacgaacaucuggcugaagcuccgggacagcuacacccaggugugcgaccaccgccugauguccgccgccaucaaggacagcaaggcggugcacgccgacaugggcuacuggaucgaguccgagaagaacgagaccuggaagcugacccgggccagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgccggccccuggcaccuggggaagcucgagcuggacuucggccugugcgagggcacgaccguggucguggacgagcacugcgggaaccggggcccgucccuccgcaccaccacggugaccgggaagaucauccacgaguggugcugccggagcugcacccugccgccccugcgcuucaagggcgaggacgggugcugguacggcauggagauccggcccgucaaggagaaggaggagaaccucgugaaguccauggugagcgccggcagcggggaggucgacuccuucagccugggccugcucugcaucuccaucaugaucgaggaggugaugcgcagccgguggucccgcaagaugcugaugaccgggacgcuggcgguguuccuccugcugaucaugggccagcucaccuggaacgaccugauccggcugugcaucauggucggggccaacgccagcgacaagaugggcaugggcaccaccuaccucgcccugauggccacguuccgcaugcgcccgauguucgccguggggcuccuguuccggcgccugaccucccgggagguccugcuccugaccguggggcugagccucguggccuccgucgagcugcccaacagccuggaggagcucggggacggccuggccaugggcaucaugaugcugaagcuccugaccgacuuccagucccaccagcugugggccacgcuccugagccugaccuucgugaagaccaccuucucccuccacuacgccuggaagacgauggcgaugauccugagcaucgugucccuguucccccucugccugagcaccaccucccagaagaccacguggcugcccguccuccuggggagccugggcugcaagccgcucaccauguuccugaucaccgagaacaagaucugggggcgcaaguccuggccccugaacgagggcaucauggccguggggaucgugagcauccuccugagcucccugcucaagaacgacgucccccuggccggcccccugaucgccggcgggaugcucaucgcgugcuacgugaucagcggcuccagcgccgaccugucccuggagaaggccgccgaggugagcugggaggaggaggccgagcacuccggggcgagccacaacauccucgucgaggugcaggacgacggcaccaugaagaucaaggacgaggagcgggacgacacccugacgauccugcucaaggccacccugcuggccaucuccgggguguacccgaugagcauccccgccacccucuucgucugguacuucuggcagaagaagaagcagcgcuccggcgugcugugggacacccccagcccgcccgagguggagcgggccguccuggacgacggcaucuaccgcauccugcagcgggggcuccugggcaagucccaggugggggugggcgucuuccaggaggggguguuccacacgauguggcacgugacccgcggcgcgguccugauguaccagggcaagcggcucgagcccagcugggccuccgugaagaaggaccugaucagcuacgggggcggguggcgcuuccagggcuccuggaacaugggggaggaggugcaggucaucgccguggagcccggcaagaaccccaagaacgugcagaccgcccccggcaccuucaagacgcccgagggggaggucggcgccaucgcgcuggacuucaagcccgggaccagcggcucccccaucgugaaccgggagggcaagaucguggggcucuacggcaacggggucgugaccaccagcggcacguacgugagcgccaucgcccaggccaaggccucccaggaggggccgcugcccgagaucgaggacgaggucuuccgcaagcggaaccugaccaucauggaccuccaccccggcagcggcaagacccgccgguaccugccggcgaucgugcgcgaggccaucaagcggaagcugcgcacccucgugcuggcccccacgcgggucguggccuccgagauggcggaggcccugaaggggaugcccauccgcuaccagaccaccgccgucaagagcgagcacaccggcaaggagaucgucgaccucaugugccacgccacguucaccaugcgccugcugucccccgugcgggugccgaacuacaacaugaucaucauggacgaggcccacuucaccgaccccgcgagcaucgccgcccgcggguacaucuccacccgggucggcaugggggaggccgccgcgaucuucaugacggccacgccgcccggcagcauggaggccuucccgcaguccaacgccgccauccaggacgaggagcgcgacauccccgagcggagcuggaacuccggcuacgacuggaucaccgacuuccccgggaagaccgugugguucgugcccagcaucaaguccggcaacgacaucgcgaacugccuccgcaagaacgggaagcgggucgugcagcugagccgcaagacguucgacaccgaguaccagaagaccaagaacaacgacugggacuacguggucaccacggacaucuccgagaugggcgccaacuuccgggccgaccgcgugaucgacccgcggcgcugccugaagcccgucauccucaaggacgggcccgagcgggugauccuggccggccccaugccggugaccgucgcgagcgccgcccagcgccggggccgcaucgggcggaaccagaacaaggagggcgaccaguacaucuacauggggcagccccugaacaacgacgaggaccacgcccacuggaccgaggccaagaugcuccuggacaacaucaacacccccgagggcaucauccccgcgcuguucgagccggagcgcgagaaguccgccgccaucgacggggaguaccggcuccgcggcgaggcccgcaagacguucguggagcugaugcggcgcggcgaccugcccguguggcucagcuacaaggucgccuccgagggguuccaguacagcgaccggcgcuggugcuucgacggcgagcggaacaaccaggugcugcugaagaacauggacguggagaucuggaccaaggagggggagcgcaagaagcuccggccccgcuggcuggacgcgcggaccuacagcgacccccuggcccuccgcgaguucaaggaguucgccgccggccggcgcuccgucagcggcgaccugauccuggagaucgggaagcucccgcagcaccugacccagcgggcccagaacgcgcuggacaaccucgugaugcugcacaacuccgagcagggcgggaaggccuaccgccacgccauggaggagcugcccgacacgaucgagacccucaugcugcuggcccucaucgcggugcugaccggcggggucacccuguucuuccucagcggccggggccuggggaagaccuccaucggccugcucugcgugauggccagcuccgcccugcuguggauggccagcguggagccccacuggaucgccgcguccaucauccucgaguucuuccugaugguccugcucauccccgagccggaccgccagcggacgccccaggacaaccagcuggccuacguggugaucgggcuccucuucaugauccugaccgucgccgccaacgagaugggccugcucgagaccaccaagaaggaccuggggaucggccacguggccgcggagagccaccaccacgccgccaugcuggacguggaccuccaccccgccuccgccuggacgcuguacgcggucgccaccaccaucaucaccccgaugaugcgccacacgaucgagaacaccaccgccaacaucagccugaccgccaucgccaaccaggcggccauccucaugggccuggacaagggguggcccaucuccaagauggacaucggcgugccccugcucgcccuggggugcuacagccaggugaacccccugacgcucaccgccgcgguccugaugcugguggcccacuacgccaucaucggcccggggcuccaggccaaggccacccgggaggcgcagaagcgcaccgccgccggcaucaugaagaaccccacgguggacggcaucgucgccaucgaccuggaccccgugguguacgacgccaaguucgagaagcagcuggggcagaucaugcuccugauccugugcaccucccagauccuccugaugcggaccaccugggcgcugugcgagagcaucacgcucgccaccggcccccugaccacccugugggagggguccccgggcaaguucuggaacacgaccaucgccgucagcauggccaacaucuuccgcggcuccuaccucgccggggcgggccuggccuucagccugaugaagucccucgggggcgggcgccggggcaccggcgcccagggggagacccugggcgagaaguggaagcgccagcugaaccagcucuccaagagcgaguucaacacguacaagcgguccgggaucaucgagguggaccgcagcgaggccaaggagggccugaagcgcggggagaccaccaagcacgcggugucccgcggcaccgccaagcugcggugguucgucgagcgcaaccuggugaagcccgagggcaaggugaucgaccucgggugcggccgcggcggguggagcuacuacugcgccgggcugaagaaggucacggaggugaagggguacaccaagggcgggcccggccacgaggagcccaucccgauggccaccuacggguggaaccuggugaagcucuacuccggcaaggacgucuucuucacgccgcccgagaagugcgacacgcugcugugcgacaucggggagagcucccccaacccgaccaucgaggagggccgcacccuccgggugcugaagaugguggagcccuggcugcgcggcaaccaguucugcaucaagguccucaaccccuacaugcccagcgugguggagacccuggagcagaugcagcggaagcacgggggcaugcugguccgcaacccgcucucccggaacagcacccacgagauguacuggguguccugcgggacgggcaacaucgugagcgccgucaacaugaccucccgcaugcugcugaaccgguucaccauggcgcaccgcaagcccaccuacgagcgggacguggaccucggcgccgggacgcgcaacguggccgucgagcccgagguggccaaccuggacaucaucggccagcgcaucgagaacaucaagaacgagcacaagagcaccuggcacuacgacgaggacaaccccuacaagaccugggccuaccacggguccuacgaggucaagccgagcggcuccgcgagcagcauggugaacggggugguccggcugcucaccaagcccugggacgugauccccauggugacgcagaucgccaugaccgacaccacccccuucggccagcagcgcgucuucaaggagaagguggacacgcggaccccgaaggccaagcgcggcaccgcccagaucauggaggugaccgcccgguggcuguggggguuccugucccgcaacaagaagccccggaucugcacgcgcgaggaguucacccggaagguccgcagcaacgcggccaucggcgccguguucaucgacgagaaccaguggaacuccgccaaggaggcgguggaggacgagcgguucugggaccucguccaccgcgagcgggagcugcacaagcaggggaagugcgcgaccugcguguacaacaugaugggcaagcgcgagaagaagcugggggaguucggcaaggccaagggcagccgggccaucugguacauguggcucggggcccgcuuccuggaguucgaggcgcugggcuucaugaacgaggaccacugguucucccgggagaacagccucuccgggguggagggcgaggggcugcacaagcugggcuacauccuccgcgacaucagcaagauccccggcgggaacauguacgccgacgacaccgccggcugggacacgcggaucaccgaggacgaccugcagaacgaggccaagaucaccgacaucauggagccggagcacgcccugcucgcgaccuccaucuucaagcugacguaccagaacaaggucgugcgcgugcagcggcccgccaagaacgggaccgucauggacgugaucagccgccgcgaccagcggggcuccggccagguggggaccuacggccugaacaccuucacgaacauggaggcccagcucauccgccagauggagagcgaggggaucuuccugcccuccgagcuggagacccccaaccucgccgagcggguccuggacuggcuggagaagcacggcaucgagcgccucaagcggauggccaucagcggggacgacugcguggugaagccgaucgacgaccgcuucgcgaccgcccugaccgcccugaacgacaugggcaagguccggaaggacaucccccagugggagcccuccaagggcuggaacgacuggcagcagguccccuucugcagccaccacuuccaccagcucaucaugaaggacgggcgcgagaucguggucccgugccggaaccaggacgagcuggugggccgcgcccgggugucccagggggccggcuggagccugcgcgagacggcgugccucggcaagagcuacgcccagauguggcagcugauguacuuccaccggcgcgaccugcggcucgccgccaacgcgaucugcuccgccguccccguggacugggugcccaccagccgcaccaccugguccauccacgcccaccaccaguggaugacgaccgaggacaugcugagcgucuggaaccggguguggaucgaggagaaccccuggauggaggacaagacccacguguccagcugggaggacgucccguaccugggcaagcgcgaggaccaguggugcggcucccucaucgggcugaccgcccgggccaccugggcgacgaacauccagguggccaucaaccaggugcgccgccugaucggcaacgagaacuaccucgacuacaugaccagcaugaagcgguucaagaacgagaacgaccccgagggggcccugugguga

SEQ ID NO: 8178 - RNA, 9879 nt, Artificial Sequence
  derived and/or modified CDS sequence (opt1) from DENV-1__KF921911__SS-prME
agcgugaccaugcugcucaugcugcugcccaccgcccucgccuuccaccugaccacccggggcggggagccccacaugaucgucagcaagcaggagcggggcaagagccugcuguucaagaccagcguggggaucaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcggaccgagaccuggaugagcuccgagggcgccuggaagcagauccagaaggucgagaccugggcccugcggcaccccggguucacggugaccgcccuguuccucgcccacgcgaucggcaccagcaucacccagaaggggaucaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccgcaagcugugcaucgaggcgaagaucagcaacaccacgaccgacucccggugcccgacccagggcgaggccacccugguggaggagcaggacagcaacuucgucugccgccggacguucguggaccgcggcugggggaacggcugcggccucuucggcaaggggucccugcugaccugcgccaaguucaagugcgugaccaagcucgagggcaagaucguccaguacgagaaccugaaguacagcgugaucgugaccguccacacgggcgaccagcaccagguggggaacgagaccaccgagcacggcaccaucgccaccaucacgccccaggcccccaccuccgagauccagcugaccgacuacggggcgcucacccuggacugcagcccccggacgggccuggacuucaacgagaugguccuccugaccaugaaggagaaguccuggcuggugcacaagcagugguuccucgaccugccgcugcccuggaccagcggggccagcaccucccaggagacguggaaccgccaggaccuccuggugaccuucaagaccgcccacgccaagaagcaggaggucguggugcugggcagccaggagggcgccaugcacaccgcgcucacgggggccaccgagauccagaccuccggcaccacgaccaucuucgccgggcaccugaagugccggcugaagauggacaagcucacccugaagggcaugagcuacgucaugugcaccggguccuucaagcuggagaaggagguggccgagacgcagcacggcaccgugcugguccaggugaaguacgagggcaccgacgcccccugcaagauccccuucagcgcgcaggacgagaagggggugacccagaacggccgccucaucacggccaacccgaucgucaccgacaaggagaagcccgugaacaucgagaccgagccgcccuucggggaguccuacaucgugaucggcgccggcgagaaggcccugaagcugagcugguucaagaagggguccagcaucggcaagauguucgaggcgaccgcccgcggggcccgccggauggccauccucggcgacacggccugggacuucggguccaucggcggcgucuucaccagcguggggaagcuggugcaccaggucuucggcgcggccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucaccguggucgugggggacgccaacggcauccuggcgcaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgccuggaacaucugggagguggaggacuacggcuucgggaucuucaccaccaacaucuggcugaagcuccgggacagcuacacgcagaugugcgaccaccgccugauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgucgugguggacgagcacugcggcaaccgggggccgucccuccgcacgaccaccgucaccggcaagaucauccacgaguggugcugccggagcugcacgcugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggaaccgcaagaugcucaugaccggcacccuggccguguuccugcuccugaucauggggcagcugaccuggaacgaccucauccgccugugcaucauggugggcgccaacgcguccgaccggauggggaugggcacgaccuaccuggcccucauggccaccuucaagaugcgcccgauguucgccgucggccugcuguuccggcgccucaccagccgggaggugcugcugcucacgaucgggcugucccugguggccagcgucgagcuccccaacucccuggaggagcugggcgacgggcucgcgaugggcaucaugaugcugaagcugcucaccgaguuccagccccaccagcuguggaccacccugcucagccugacguucaucaagaccacccugucccucgacuacgccuggcgcaccauggccauggugcugagcaucgucucccuguucccccucugccugagcacgaccucccagaagaccaccuggcugccggugcuccugggcagcuucgggugcaagccccugacgauguuccucaucaccgagaacaagaucuggggccggaaguccuggccccugaacgaggggaucauggccaucggcaucgugagcauccugcucuccagccugcugaagaacgacgucccccucgcggggccgcugaucgccggcggcaugcugaucgccugcuacgugaucagcggguccagcgccgaccucucccuggagaaggccgcggaggugagcugggaggaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgccacccuguucgugugguacuucuggcagaagaagaagcagcgguccggggugcucugggacacccccagcccgcccgaggucgagcgcgcggugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggccaucgcgcuggacuucaagcccggcaccagcggguccccgaucgugaaccgggagggcaagaucgucagccuguacggcaacgggguggugacgaccuccggcaccuacgucagcgccaucgcccaggccaagaccagccaggaggggccccuccccgagaucgaggacgagguguucaagaagcgcaaccugacgaucauggaccugcacccgggcuccgggaagacccggcgcuaccuccccgccaucgugcgggaggcgaucaagcgcaagcugcgcacccugauccucgcccccacccgggucguggccagcgagauggccgaggcgcugaagggcaugcccauccgcuaccagacgaccgccgugaaguccgagcacaccggccgggagaucgucgaccugaugugccacgccaccuucacgaugcgccuccugagcccggugcgggugcccaacuacaacaugaucaucauggacgaggcccacuucaccgaccccgccuccaucgcggcccgcggguacaucagcacccgggucggcaugggggaggccgccgccaucuucaugaccgcgacgcccccgggcuccguggaggccuucccccagagcaacgccgugauccaggacgaggagcgcgacauccccgagcgguccuggaacagcggguacgacuggaucaccgacuuccccggcaagaccgucugguucgugccguccaucaagagcggcaacgacaucgccaacugccugcgcaagaacgggaagcgggugauccagcucucccgcaagaccuucgacacggaguaccagaagaccaagaacaacgacugggacuacgucgugaccaccgacaucagcgagaugggcgccaacuuccgggcggaccgcgugaucgacccccggcgcugccugaagcccgucauccugaaggacgggcccgagcgggugauccucgccggcccgaugcccgugacggucgccuccgccgcgcagcgccgggggcgcaucggccgcaaccagaacaaggagggcgaccaguacguguacauggggcagccccugaacaacgacgaggaccacgcccacuggaccgaggccaagaugcugcucgacaacaucaacacccccgagggcaucaucccggcccuguucgagcccgagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacuccgaccggcgcuggugcuucgacggcgagcggaacaaccagguccucgaggagaacauggacguggagaucuggacgaaggagggggagcgcaagaagcugcggccccgcuggcuggacgcccggaccuacagcgacccgcucgcccugcgcgaguucaaggaguucgcggccggccggcgcagcguguccggggaccugauccucgagaucggcaagcugccccagcaccugacccuccgggcccagaacgcccuggacaaccuggucaugcuccacaacagcgagcagggcgggaaggccuaccgccacgcgauggaggagcugcccgacaccaucgagacccugaugcuccuggcccugaucgccgugcucacgggcggggugacccuguucuuccuguccggcaaggggcucggcaagaccagcaucggccugcugugcgucauggccuccagcgcgcuccuguggauggccaacguggagccccacuggaucgccgccuccaucauccuggaguucuuccucauggugcugcugaucccggagcccgaccggcagcgcacgccccaggacaaccagcucgccuacgucgugaucgggcugcuguucaugauccucacgguggcggccaacgagaugggccugcuggagaccaccaagaaggaccucgggaucggccacgucgccgccgagaaccagcaccacgccaccaugcuggacguggaccugcggccggcgagcgccuggacgcucuacgccguggccaccaccgucaucacccccaugaugcgccacacgaucgagaacaccaccgccaacaucucccugaccgcgaucgccaaccaggccgccauccugauggggcucgacaagggcuggcccaucagcaagauggacaucggcgugccccugcuggcccucgggugcuacucccaggugaacccgcugacgcugaccgcggccguccucaugcugguggcccacuacgccaucaucggccccgggcugcaggcgaaggccacccgcgaggcccagaagcggaccgccgccggcaucaugaagaaccccacgguggacgggaucgucgcgaucgaccucgaccccgugguguacgacgccaaguucgagaagcagcugggccagaucaugcugcucauccugugcaccagccagauccugcucaugcgcaccaccugggcccugugcgaguccaucacgcuggccaccggcccgcucaccacccugugggaggggagccccggcaaguucuggaacacgaccaucgccgucuccauggcgaacaucuuccgggggagcuaccuggccggcgccggccucgccuucucccugaugaagucccucgggggcgggcgccgggggaccggggcccagggcgagacccucggcgagaaguggaagcgccagcugaaccagcuguccaagagcgaguucaacacguacaagcggagcgggaucauggagguggaccgcuccgaggcgaaggagggccucaagcgcggggagaccaccaagcacgccgugagccgcggcaccgccaagcugcggugguucgucgagcgcaaccuggugaagcccgaggggaaggugaucgaccugggcugcggccgcggcgggugguccuacuacugcgccgggcucaagaaggucacggaggugaagggguacaccaagggcgggcccggccacgaggagccgauccccauggcgaccuacggguggaaccuggugaagcuguacagcggcaaggacgucuucuucacgccgcccgagaagugcgacacccuccugugcgacaucggggaguccagcccgaaccccacgaucgaggagggccgcacccugcgggugcucaagaugguggagcccuggcugcgcgggaaccaguucugcaucaagauccugaaccccuacaugccguccgucguggagacccucgagcagaugcagcggaagcacggcggcaugcuggugcgcaacccccugagccggaacuccacccacgagauguacugggucagcugcgggacgggcaacaucguguccgccgugaacaugaccagccgcaugcuccugaaccgcuucaccauggcccaccggaagcccaccuacgagcgcgacgucgaccugggggccggcacgcggcacguggccguggagcccgaggucgcgaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggugaacggggucgugcggcugcugaccaagcccugggacgucauccccauggugacgcagaucgccaugaccgacaccaccccguucggccagcagcgcguguucaaggagaaggucgacacgcggacgccccgggccaagcgggggaccgcgcagaucauggaggugaccgccaaguggcucuggggcuuccugucccgcaacaagaagccccggaucugcacgcgcgaggaguucacccggaaggugcgcagcaacgccgccaucggcgccgucuucguggacgagaaccaguggaacagcgcgaaggaggccguggaggacgagcgguucugggaccuggucuaccgcgagcgggagcuccacaagcaggggaagugcgcgaccugcguguacaacaugaugggcaagcgcgagaagaagcugggggaguucggcaaggccaaggggucccgggcgaucugguacauguggcugggcgcccgcuuccucgaguucgaggcccugggcuucaugaacgaggaccacugguucagccgggagaacuccuucagcgggguggagggcgaggggcugcacaagcucggcuacauccugcgcgacaucuccaagauccccgggggcaacauguacgccgacgacaccgccggcugggacacgcgcaucaccgaggacgaccugcagaacgaggcgaagaucaccgacaucauggagcccgagcacgcccuccuggccaccagcaucuucaagcugacguaccagaacaaggucgugcgggugcagcgccccgccaagaacgggaccgucauggacgugaucucccggcgcgaccagcggggcagcggccagguggggaccuacggccucaacaccuucacgaacauggagguccagcugauccgccagauggaguccgaggggaucuuccugcccagcgagcucgagaccccgaaccuggccgagcgggugcuggacuggcucgagaagcacggcaccgagcgccugaagcggauggcgaucuccggggacgacugcguggucaagcccguggacgaccgcuucgccaccgcccugaucgcccucaacgacaugggcaaggugcggaaggacaucccccagugggagcccagcaagggguggaacgacuggcagcaggucccguucugcucccaccacuuccaccagcugaucaugaaggacggccgcgagaucguggugcccugccggaaccaggacgagcuggucggccgcgcccgggugagccagggggcgggcuggucccuccgcgagacggccugccugggcaagagcuacgcccagauguggcagcugauguacuuccaccggcgcgaccuccggcuggccgccaacgcgaucugcuccgccgugcccgucgacugggugcccaccagccgcaccaccuggagcauccacgcccaccaccaguggaugaccacggaggacaugcuguccguguggaaccgcgucuggaucgaggagaacccguggauggaggacaagacccacgugagcuccugggaggaggugcccuaccucggcaagcgggaggaccaguggugcgggagccugaucggccugaccgcccgcgcgaccugggccacgaacauccaggucgccaucaaccaggugcggcgccucaucggcaacgagaacuaccuggacuacaugaccuccaugaagcgguucaagaacgagagcgaccccgagggggcccugugguga

SEQ ID NO: 8179 - RNA, 9879 nt, Artificial Sequence
  derived and/or modified CDS sequence (opt1) from DENV-1__KJ189350__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacacgugggucaccuacgggaccugcagccagaacggcgagcaccggcgcgagaagcgguccguggcccuggcgccccacgugggccuggggcucgagacccgcacggagaccuggaugagcuccgagggcgccuggaagcagauccagcgggucgagaccugggcccugcgccacccgggguucaccgugaucgccuucuuccuggcgcacgccaucggcacgagcaucacccagaaggggaucaucuucauccuccugaugcuggugacccccuccauggccaugcggugcgucggcaucggcaaccgcgacuucguggaggggcucagcggcgccaccuggguggacgucgugcuggagcacggguccugcgugacgaccauggccaagaacaagcccacccuggacaucgagcuccugaagaccgaggucacgaaccccgcggugcugcggaagcucugcaucgaggccaagaucagcaacaccaccaccgacucccgcugcccgacgcagggcgaggccacccugguggaggagcaggacgccaacuucgucugccggcgcaccuucguggaccggggcugggggaacggcugcgggcuguucggcaaggggagccuccugaccugcgccaaguucaagugcgugacgaagcuggagggcaagaucguccaguacgagaaccucaaguacuccgugaucgugaccguccacaccggcgaccagcaccagguggggaacgagaccacggagcacggcaccaucgcgaccaucaccccccaggcccccaccagcgagauccagcugacggacuacggggcccugacccucgacugcuccccccgcaccggccuggacuucaacgagaugguccugcucaccaugaaggagaagagcuggcuggugcacaagcagugguuccuggaccucccgcugcccuggacguccggggccagcaccagccaggagaccuggaaccggcaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccgccugaagauggacaagcugacgcucaagggcauguccuacgucaugugcaccgggagcuucaagcuggagaaggagguggcggagacccagcacggcaccgugcugguccaggugaaguacgagggcacggacgcccccugcaagauccccuucuccacccaggacgagaagggggugacccagaacggccggcugaucaccgccaacccgaucgucacggacaaggagaagcccgugaacaucgagaccgagccccccuucggggagagcuacaucguggucggcgccggcgagaaggcgcucaagcuguccugguucaagcgcgggagcuccaucggcaagauguucgaggccaccgcccggggggcccgccgcauggccauccugggcgacaccgcgugggacuucgggagcaucggcggcguguucacguccguggggaagcucguccaccagaucuucggcaccgccuacggggugcuguucagcggcguguccuggaccaugaagaucgggaucggcauccugcucaccuggcugggccugaacagccgguccacgagccucuccaugaccugcaucgccgucgggauggugacccuguaccugggcgugaugguccaggccgacagcgggugcgugaucaacuggaagggccgcgagcucaagugcggguccggcaucuucgugaccaacgagguccacacguggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaagagcuggggcaaggccaagaucaucggcgccgacauccagaacaccacguucaucaucgacgggcccgacaccccggagugccccgacggccagcgggccuggaacaucugggagguggaggacuacggguucggcgucuucaccaccaacaucuggcugaagcugcgcgacuccuacacgcagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcaccuggcccaagagccacacgcugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcaccacggugguggucgacgagcacugcgggaaccgcggcccgagccugcggaccaccaccgugacggggaagaucauccacgaguggugcugccgcuccugcacccuccccccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacccucgccguguuccugcugcucaucaugggccagcugacguggaacgaccugauccggcucugcaucauggucggggccaacgcguccgaccgcaugggcaugggcaccaccuaccuggcccugauggccaccuucaagaugcggccgauguucgccguggggcuccuguuccgccggcugacgagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggaccacgcugcugagccucaccuucgucaagaccacccugucccuggacuacgccuggaagacgaccgccauggcccucagcaucgugucccuguucccccugugccucagcaccaccucccagaagacgaccuggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcaccaugaagaucaaggacgaggagcgcgacgacacgcugaccauccuccugaaggccacccugcucgcggucagcgggguguaccccauguccauccccgccacccuguucgugugguacuucuggcagaagaagaagcagcggagcggcguccugugggacacgcccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacaccggggaggaggugcaggugaucgcggucgagcccggcaagaacccgaagaacgugcagacgacccccggcaccuucaagacccccgagggggaggugggcgccaucgcccucgacuucaagcccgggacguccggcagcccgaucgucaaccgggagggcaagaucguggggcuguacggcaacgggguggucaccaccuccggcaccuacgugagcgccaucgcccaggcgaaggccagccaggaggggccccugcccgagaucgaggacgagguguucaagaagcgcaaccucacgaucauggaccugcacccgggcuccggcaagacccggcgcuaccugcccgccaucguccgggaggccaucaagcgcaagcuccgcacccugauccuggcgcccacccgggugguggccagcgagauggccgaggcccucaaggggaugcccauccgcuaccagacgaccgccgucaaguccgagcacaccggccgggagaucguggaccugaugugccacgcgaccuucacgaugcgccugcucagcccggugcggguccccaacuacaacaugaucaucauggacgaggcccacuucaccgaccccgccuccaucgccgcccgcggguacaucagcacccgggugggcaugggggaggcggccgccaucuucaugaccgccacgcccccgggcuccguggaggccuucccccagagcaacgcggucauccaggacgaggagcgcgacauccccgagcgguccuggaacagcggcuacgacuggaucaccgacuuccccgggaagaccgugugguucgugccguccaucaagagcggcaacgacaucgccaacugccugcgcaagaacgggaagcgggucauccagcugucccgcaagaccuucgacacggaguaccagaagaccaagaacaacgacugggacuacguggugaccaccgacaucagcgagaugggcgccaacuuccgggccgaccgcgucaucgacccccggcgcugccucaagcccgugauccugaaggacgggcccgagcgggugauccuggcgggcccgaugcccgucacggccgccuccgccgcccagcgccggggccgcaucgggcgcaaccagaacaaggagggcgaccaguacguguacauggggcagccccucaacaacgacgaggaccacgcgcacuggaccgaggccaagaugcugcuggacaacaucaacacccccgagggcaucaucccggcccucuucgagcccgagcgggagaagagcgccgccaucgacggggaguaccgccugcggggcgaggcgcgcaagaccuucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggacgaaggagggggagcgcaagaagcuccggccccgcuggcuggacgcccggaccuacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacccugaugcugcucgcccugaucgccgugcugacgggcggggugacccucuucuuccuguccggcaagggccuggggaagaccagcaucggccuccugugcgucaccgccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccaccaagaaggaccuggggaucggcuacgucgccgccgagaaccaccagcacgccacgaugcucgacguggaccugcacccggccuccgcguggacccuguacgccguggccaccaccgucaucacgcccaugaugcggcacaccaucgagaacaccaccgccaacaucagccucacggccaucgcgaaccaggccgccauccugaugggccuggacaagggguggcccaucuccaagauggacaucggcgugccccuccuggcccuggggugcuacagccaggugaacccgcucacccugaccgcggccguccugaugcucguggcccacuacgccaucaucggccccgggcugcaggccaaggcgacccgcgaggcccagaagcgcacggccgccggcaucaugaagaaccccaccguggacggcaucgucgccaucgaccuggaccccgugguguacgacgcgaaguucgagaagcagcucgggcagaucaugcugcugauccucugcaccucccagauccugcugaugcggaccacgugggcccucugcgagagcaucacccuggccaccggcccgcugaccacgcucugggaggggucccccggcaaguucuggaacaccaccaucgccgucagcauggccaacaucuuccgcggcuccuaccuggcgggggccggccuggccuucagccucaugaagucccuggggggcgggcggcgcggcaccggcgcccagggggagacgcugggcgagaaguggaagcggcagcucaaccagcugagcaagagcgaguucaacaccuacaagcgcuccgggaucauggagguggaccggagcgaggcgaaggagggccugaagcgcggggagaccaccaagcacgccgugucccggggcacggccaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccccccgagaagugcgacacccugcucugcgacaucggggagagcuccccgaaccccacgaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacccacgagauguacugggucuccugcgggacgggcaacaucgugagcgcggugaacaugaccucccgcaugcugcucaaccgcuucaccauggcccaccggaagcccaccuacgagcgcgacgucgaccugggcgccgggacgcggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcuccugaccaagcccugggacgucauccccauggugacgcagaucgccaugaccgacaccaccccguucggccagcagcgcguguucaaggagaaggucgacacgcggaccccccgcgccaagcggggcaccacccagaucauggaggugacggccaaguggcuguggggguuccucagccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgccaccugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagaucccgggcgggaacauguacgccgacgacacggccggcugggacacccgcgucaccgaggacgaccugcagaacgaggccaagaucaccgacaucauggagcccgagcacgcccuccuggcgacguccaucuucaagcugaccuaccagaacaagguggugcggguccagcgccccgccaagaacgggaccgugauggacgugaucagccggcgcgaccagcggggcuccggccaggucgggaccuacggccucaacacguucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggcgaucagcggggacgacugcguggucaagcccaucgacgaccgcuucgccaccgcccugacggcccucaacgacaugggcaaggugcggaaggacaucccccagugggagcccuccaagggcuggaacgacuggcagcaggugccguucugcagccaccacuuccaccagcugaucaugaaggacgggcgcgagaucgucgugcccugccggaaccaggacgagcuggugggccgcgcccgggucucccagggggcgggcuggagccuccgcgagaccgccugccuggggaaguccuacgcccagauguggcagcugauguacuuccaccggcgcgaccuccggcuggccgcgaacgccaucugcagcgccgugcccguggacuggguccccaccagccgcaccaccugguccauccacgcccaccaccaguggaugacgaccgaggacaugcugagcguguggaaccgcguguggaucgaggagaacccguggauggagaacaagacccacgucuccagcugggaggaggugcccuaccucggcaagcgggaggaccaguggugcggcucccugaucgggcugaccgcccgcgcgacgugggccaccaacauccagguggccaucaaccagguccggcgccucaucggcaacgagaacuaccuggacuacaugaccagcaugaagcgguucaagaacgaguccgacagcgagggggcccugugguga

SEQ ID NO: 8180 - RNA, 9879 nt, Artificial Sequence
  derived and/or modified CDS sequence (opt1) from DENV-1__KJ189351__SS-prME
agcgugaccaugcugcucaugcugcugcccaccgugcucgccuuccaccugaccacccggggcggggagccccacaugaucgugagcaagcaggagcggggcaagagccuccuguucaagaccagcgccggggugaacaugugcacccugaucgcgauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgggagaagcgguccguggcccuggcgccccacgucggccuggggcucgagacgcgcaccgagaccuggaugagcuccgagggcgccuggaagcagauccagcggguggagaccugggcccugcgccaccccggguucacggugaucgccuucuuccuggcccacgcgaucggcaccagcaucacccagaaggggaucaucuucauccuccugaugcuggugacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggacccccggggccuccaccagccaggagaccuggaaccggcaggaccugcucgucacguucaagaccgcccacgccaagaagcaggagguggugguccugggcagccaggagggcgcgaugcacaccgcccugaccggggccacggagauccagaccuccggcaccaccacgaucuucgccgggcaccucaagugccgccugaagauggacaagcugacccucaagggcaugagcuacgugaugugcaccggguccuucaagcuggagaaggagguggccgagacccagcacggcacgguccugguccaggugaaguacgagggcaccgacgcgcccugcaagaucccguucagcacccaggacgagaagggggucacccagaacggccggcugaucacggccaaccccaucgugaccgacaaggagaagcccgugaacaucgagaccgagcccccguucggggaguccuacaucgucgugggcgccggcgagaaggcccucaagcugagcugguucaagcgcggguccagcaucggcaagauguucgaggcgaccgcccgcggggcccgccgcauggccauccugggcgacacggccugggacuucggguccaucggcggcguguucaccagcgucgggaagcucgugcaccagguguucggcaccgcguacgggguccuguucuccggcgugagcuggaccaugaagaucgggaucggcauccugcucacguggcugggccugaacucccggagcaccucccucagcaugaccugcaucgccguggggauggucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacucccccaagcggcugagcgccgcgaucggcaaggccugggaggagggggucugcggcauccgcagcgccacccggcuggagaacaucauguggaagcagaucuccaacgagcucaaccacauccugcuggagaacgacaugaaguucaccgugguggucggggacgccaacggcauccucgcccaggggaagaagaugauccgcccccagcccauggagcacaaguacagcuggaaguccuggggcaaggcgaagaucaucggcgccgacauccagaacacgaccuucaucaucgacgggccggacacccccgagugccccgacggccagcgggccuggaacaucugggagguggaggacuacggguucggcguguucaccacgaacaucuggcugaagcugcgcgacagcuacacccagaugugcgaccaccggcucauguccgccgcgaucaaggacagcaaggccguccacgccgacaugggcuacuggaucgaguccgagaagaacgagaccuggaagcuggcccgcgccagcuucaucgaggugaagaccugcacguggcccaagucccacacccuguggagcaacggggugcucgaguccgagaugaucaucccgaagaucuacggcgggcccaucagccagcacaacuaccggcccggcuacuucacccagaccgcggggccguggcaccugggcaagcuggagcucgacuucgaccugugcgagggcacgaccgucgugguggacgagcacugcgggaaccgcggccccucccugcggaccaccacggucaccgggaagaucauccacgaguggugcugccgcagcugcacccugccgccccugcgguuccgcggcgaggacgggugcugguacggcauggagauccggccggugaaggagaaggaggagaaccuggugcgcuccauggucagcgccggcuccggggagguggacagcuucagccucggcauccugugcguguccaucaugaucgaggaggucaugcggagccgcuggucccgcaagaugcugaugaccgggacgcucgccguguuccugcugcucaucaugggccagcugaccuggaacgaccugacccggcucugcaucauggugggggccaacgccagcgaccgcaugggcaugggcaccacguaccuggcgcugauggccaccuucaagaugcggcccauguucgccgucgggcuccuguuccgccggcugaccucccgcgaggugcuccugcugaccaucggccucagccuggucgccuccguggagcugcccaacagccucgaggagcugggggacggccuggccaugggcaucaugaugcucaagcugcugacggaguuccagccccaccagcucuggaccacccugcugucccucaccuucgugaagacgacccugagccuggacuacgcguggaagaccaccgccauggcccucuccaucgucagccuguucccgcugugccucuccacgaccagccagaagaccaccuggcugcccgugcugcucggguccuucggcugcaagccccugaccauguuccugaucgccgagaaccggaucugggggcgcaagagcuggccccucaacgagggcaucauggcgaucgggaucguguccauccugcugagcucccuccugaagaacgacgucccgcuggccggcccccucaucgccggcgggaugcugaucgccugcuacgugaucagcggcagcuccgccgaccugagccucgagaaggcggccgagguguccugggagcaggaggccgagcacagcggggccucccacagcauccuggucgaggugcaggacgacggcacgaugaagaucaaggacgaggagcgggacgacacccugaccauccuccugaaggccacccugcucgcgguguccggggucuaccccaugagcauccccgccacgcuguucgugugguacuucuggcagaagaagaagcagcgcuccggcgugcugugggacaccccguccccgcccgaggucgagcgggccgugcucgacaacggcaucuaccgcauccugcagcgggggcugcugggccgcucccaggugggggucggcguguuccaggacgggguguuccacaccauguggcacgucacccggggcgccgugcucauguaccagggcaagcgccuggagcccagcugggccuccgugaagaaggaccugaucagcuacgggggcggguggcgguuccagggcuccuggaacacgggggaggagguccaggugaucgcgguggagccgggcaagaaccccaagaacguccagaccacccccggcaccuucaagacgcccgagggggaggugggcgccaucgcccucgacuucaagccggggaccagcggcucccccaucgugaaccgcgagggcaagaucgucgggcuguacggcaacgggguggugaccaccagcggcacguacgucuccgccaucgcccaggcgaaggccagccaggaggggccccugccggagaucgaggacgagguguucaagaagcggaaccucaccaucauggaccugcaccccggcagcggcaagacccgccgguaccugcccgccaucgugcgcgaggccaucaagcgcaagcuccggacccugauccuggcgcccacgcgcgucguggccuccgagauggccgaggcccucaaggggaugccgauccgguaccagaccaccgccgucaagagcgagcacaccggccgcgagaucgucgaccugaugugccacgcgacguucaccaugcggcugcucucccccgugcgcgugcccaacuacaacaugaucaucauggacgaggcccacuucaccgaccccgccagcaucgccgcccggggguacaucuccacccgcgucggcaugggggaggcggccgccaucuucaugacggccaccccgcccggcagcguggaggccuucccccaguccaacgcggugauccaggacgaggagcgggacauccccgagcgcagcuggaacuccggcuacgacuggaucaccgacuucccggggaagaccgucugguucgugcccagcaucaaguccggcaacgacaucgccaacugccugcggaagaacgggaagcgcgugauccagcugagccggaagacguucgacaccgaguaccagaagaccaagaacaacgacugggacuacgucgugaccacggacaucuccgagaugggcgccaacuuccgcgccgaccgggugaucgacccccgccggugccucaagcccgucauccugaaggacgggccggagcgcgugauccuggcgggccccaugcccgucaccguggccagcgccgcccagcggcgcggccgcaucgggcggaaccagaacaaggagggcgaccaguacguguacauggggcagccccucaacaacgacgaggaccacgcccacuggaccgaggcgaagaugcugcuggacaacaucaacaccccggagggcaucauccccgcccucuucgagcccgagcgcgagaaguccgccgccaucgacggggaguaccggcugcgcggcgaggcccggaagacguucgucgagcugaugcgccggggcgaccuccccguguggcugagcuacaagguggcguccgagggguuccaguacagcgaccgccgguggugcuucgacggcgagcgcaacaaccagguccuggaggagaacauggacguggagaucuggaccaaggagggggagcggaagaagcuccgcccgcgguggcuggacgcccgcaccuacuccgacccccuggcccuccgggaguucaaggaguucgccgccggccgccggagcgugagcggcgaccugauccuggagaucgggaagcucccccagcaccugacccugcgcgcgcagaacgcccucgacaaccuggucaugcugcacaacuccgagcagggcgggaaggccuaccggcacgccauggaggagcuccccgacaccaucgagacgcugaugcugcucgcgcugaucgccgugcugaccggcggggugacccucuucuuccugagcggcaagggccuggggaagaccuccaucggccuccugugcgucacggccagcuccgcccugcucuggauggccagcguggagccgcacuggaucgcggccuccaucauccuggaguucuuccugauggugcuccugauccccgagcccgaccgccagcggaccccgcaggacaaccagcuggccuacgucgugaucgggcuccuguucaugauccugaccguggccgccaacgagaugggccuccuggagaccacgaagaaggaccuggggaucggcuacgucgcggccgagaaccaccagcacgccaccaugcucgacguggaccugcaccccgccagcgccuggacccuguacgcgguggccaccacggucaucacccccaugaugcgccacaccaucgagaacaccacggccaacaucucccucaccgccaucgccaaccaggcggccauccugaugggccuggacaagggguggcccaucagcaagauggacaucggcgugccgcuccuggcccuggggugcuacucccaggugaacccccucacccugaccgccgcgguccugaugcucguggcccacuacgccaucaucggccccgggcugcaggccaaggccacgcgcgaggcgcagaagcggaccgccgccggcaucaugaagaaccccaccguggacggcaucgucgccaucgaccuggacccggugguguacgacgccaaguucgagaagcagcucgggcagaucaugcugcugauccucugcaccagccagauccugcugaugcgcacgaccugggcgcucugcgaguccaucacccuggccaccggcccccugacgacccucugggaggggagccccggcaaguucuggaacaccaccaucgccgucuccauggccaacaucuuccggggcagcuaccuggccggggcgggccuggccuucucccucaugaagucccucgggggcgggcgccggggcacgggcgcccagggggagacccugggcgagaaguggaagcgccagcucaaccagcuguccaagagcgaguucaacaucuacaagcggagcgggaucauggagguggaccgcuccgaggccaaggagggccugaagcgcggggagaccaccaagcacgcggugagccgcggcacggccaagcuccggugguucgucgagcgcaaccuggugaagcccgagggcaaggugaucgaccuggggugcggccgcgggggcugguccuacuacugcgccgggcugaagaaggucaccgaggugaagggcuacaccaagggcgggccgggccacgaggagcccauccccauggccaccuacggguggaaccucgugaagcugcacagcggcaaggacgucuucuucaugcccccggagaagugcgacacccugcucugcgacaucggggaguccagccccaaccccacgaucgaggagggccgcacccugcgggugcugaagaugguggagcccuggcuccgcggcaaccaguucugcgucaagauccugaacccguacaugcccuccgugguggagacccuggagcggaugcagcgcaagcacgggggcaugcucguccggaacccccugagccgcaacuccacccacgagauguacugggugagcugcgggacgggcaacaucguguccgccgucaacaugaccagccgcaugcugcucaaccgguucaccauggcgcaccgcaagcccaccuacgagcgggacguggaccugggcgccgggacgcgccacguggccgucgagccggagguggccaaccuggacaucaucggccagcggaucgagaacaucaagaacgagcacaaguccaccuggcacuacgacgaggacaaccccuacaagaccugggccuaccacgggagcuacgaggucaaguccagcggcuccgcgagcuccauggugaacggggugguccgccuccugaccaagcccugggacgugauccccauggugacgcagaucgccaugaccgacaccaccccguucggccagcagcgggucuucaaggagaagguggacacgcgcacgccccgggccaagcgcggcaccacccagaucauggaggugacggccaaguggcuguggggguuccucagccggaacaagaagccccgcaucugcacccgggaggaguucacccgcaagguccggagcaacgccgcgaucggcgccguguucguggacgagaaccaguggaacuccgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggccaagggcagccgcgccaucugguacauguggcugggggcccgguuccuggaguucgaggcccucggcuucaugaacgaggaccacugguucucccgcgagaacagccuguccggggucgagggcgaggggcugcacaagcucggcuacauccugcgcgacaucagcaagaucccgggcgggaacauguacgcggacgacacggccggcugggacacccggaucaccgaggacgaccugcagaacgaggccaagaucaccgacaucauggagcccgagcacgcccuccuggccacguccaucuucaagcugaccuaccagaacaagguggugcgcguccagcggcccgcgaagaacgggaccgugauggacgugaucagccgccgggaccagcgcggcuccggccaggucgggaccuacggccucaacacguucaccaacauggaggugcagcugauccggcagauggagagcgaggggaucuuccugcccuccgagcucgagaccccgaaccuggccgagcgcgcccuggacuggcucgagaagcacggcgccgagcggcugaagcgcauggccaucagcggggacgacugcguggucaagcccaucgacgaccgguucgcgaccgcccugacggcccucaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcuggugggccgggcccgcgucucccagggggccggcuggagccuccgggagaccgcgugccuggggaaguccuacgcccagauguggcagcugauguacuuccaccgccgggaccuccgccuggccgccaacgcgaucugcagcgccgugcccguggacuggguccccaccagccgcaccaccugguccauccacgcccaccaccaguggaugacgaccgaggacaugcugagcguguggaaccggguguggaucgaggagaacccguggauggaggacaagacccacgucuccagcugggaggaggugcccuaccucggcaagcgcgaggaccaguggugcggcucccugaucgggcugaccgcccgggccacgugggcgaccaacauccagguggccaucaaccagguccgccggcucaucggcaacgagaacuaccuggacuacaugaccagcaugaagcgcuucaagaacgaguccgacagcgagggggcccugugguga

SEQ ID NO: 8181 - RNA, 9879 nt, Artificial Sequence
  derived and/or modified CDS sequence (opt1) from DENV-1__KJ189352__SS-prME
agcgugaccaugcugcucaugcugcugcccaccgcccucgccuuccaccugaccacccggggcggggagccccacaugaucgucagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgggagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagaucuucggcaccgccuacggggugcuguucagcggcguguccuggaccaugaagaucgggaucggcauccugcucacguggcugggccugaacagccgguccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggcgccagaucagcaacgagcucaaccacauccugcuggagaacgacaugaaguucaccguggucgugggggacgccaacggcauccucgcgcaggggaagaagaugauccggccccagcccauggagcacaaguacuccuggaaguccuggggcaaggccaaggugaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuacggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacguucaagaugcgcccgauguucgccguggggcuccuguuccggcgccugaccagccgggagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggcccucagcaucgugucccuguucccccugugccucagcaccacgucccagaagaccaccuggcugccgguccugcucgggagcuucggcugcaagccccugaccauguuccugaucaccgagaacaagaucugggggcgcaaguccuggccccucaacgagggcaucauggcgaucgggaucgugagcauccugcuguccagccuccugaagaacgacgugccccuggccggcccgcucaucgccggcgggaugcugaucgccugcuacgucaucagcggcuccagcgccgaccugucccucgagaaggcggccgaggugagcugggagcaggaggccgagcacuccggggccagccacuccauccugguggagguccaggacgacggcacgaugaagaucaaggacgaggagcgggacgacacccugaccauccuccugaaggccacccugcucgcggugagcgggguguaccccauguccauccccgccacgcuguucgucugguacuucuggcagaagaagaagcagcgcagcggcgugcugugggacacccccuccccgcccgagguggagcgggccguccucgacaacggcaucuaccgcauccugcagcgggggcugcugggccgcagccaggugggggugggcgucuuccaggacgggguguuccacaccauguggcacgugacccggggcgccguccucauguaccagggcaagcgccuggagcccuccugggccagcgugaagaaggaccugaucuccuacgggggcggguggcgguuccagggcagcuggaacacgggggaggaggugcaggucaucgcgguggagcccggcaagaacccgaagaacgugcagaccacccccggcaccuucaagacgcccgagggggaggucggcgccaucgcccucgacuucaagcccgggaccuccggcagcccgaucgugaaccgcgagggcaagaucguggggcuguacggcaacggggucgugaccaccuccggcacguacgugagcgccaucgcccaggcgaaggccagccaggaggggccccugcccgagaucgaggacgaggucuucaagaagcggaaccucaccaucauggaccugcacccgggcuccggcaagacccgccgguaccugcccgccaucgugcgcgaggccaucaagcgcaagcuccggacccugauccuggcgcccacgcgcguggucgccagcgagauggccgaggcccucaaggggaugcccauccgguaccagaccaccgccgugaaguccgagcacaccggccgcgagaucguggaccugaugugccacgcgacguucaccaugcggcugcucagcccgguccgcgugcccaacuacaacaugaucaucauggacgaggcccacuucaccgaccccgccuccaucgccgcccggggguacaucagcacccgcgugggcaugggggaggcggccgccaucuucaugacggccacgccgcccggcuccgucgaggccuucccccagagcaacgcggugauccaggacgaggagcgggacauccccgagcgcuccuggaacagcggcuacgacuggaucaccgacuuccccgggaagaccgugugguucguccccuccaucaagagcggcaacgacaucgccaacugccugcggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccucaagcccgugauccugaaggacgggcccgagcgcgucauccuggcgggcccgaugcccgugaccgccgccuccgccgcccagcggcgcggccgcaucgggcggaaccagaacaaggagggcgaccaguacgucuacauggggcagccccucaacaacgacgaggaccacgcgcacuggaccgaggccaagaugcugcuggacaacaucaacacccccgagggcaucaucccggcccucuucgagcccgagcgcgagaaguccgccgccaucgacggggaguaccggcugcgcggcgaggcgcggaagacguucguggagcugaugcgccggggcgaccuccccguguggcuguccuacaaggucgccagcgagggguuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccgcuggcccuccgggaguucaaggaguucgccgcgggccgccggagcgucuccggcgaccugauccuggagaucgggaagcucccccagcaccugacccugcgcgcccagaacgcccucgacaaccuggugaugcugcacaacagcgagcagggcgggaaggccuaccggcacgcgauggaggagcuccccgacaccaucgagacgcugaugcugcucgcccugaucgccgugcugaccggcggggucacccucuucuuccuguccggcaagggccuggggaagaccagcaucggccuccugugcgugacggccuccagcgcccugcucuggauggcguccguggagccccacuggaucgccgccagcaucauccuggaguucuuccugaugguccuccugaucccggagcccgaccgccagcggacgccccaggacaaccagcuggccuacguggugaucgggcuccuguucaugauccugaccgucgccgcgaacgagaugggccuccuggagaccacgaagaaggaccuggggaucggcuacguggccgccgagaaccaccagcacgccaccaugcucgacguggaccugcacccggccuccgcguggacccuguacgccgucgccaccacggugaucacccccaugaugcgccacaccaucgagaacaccacggccaacaucagccucaccgccaucgcgaaccaggccgccauccugaugggccuggacaagggguggcccaucuccaagauggacaucggcgugccccuccuggcccuggggugcuacagccaggucaacccgcucacccugaccgcggccgugcugaugcucguggcccacuacgccaucaucggccccgggcugcaggccaaggcgacgcgcgaggcccagaagcggaccgccgccggcaucaugaagaaccccaccgucgacggcaucguggccaucgaccuggaccccguggucuacgacgcgaaguucgagaagcagcucgggcagaucaugcugcugauccucugcaccucccagauccugcugaugcgcacgaccugggcccucugcgagagcaucacccuggccaccggcccgcugacgacccucugggaggggucccccggcaaguucuggaacaccaccaucgccgugagcauggccaacaucuuccggggcuccuaccuggcgggggccggccuggccuucagccucaugaagucccucgggggcgggcgccggggcacgggcgcccagggggagacccugggcgagaaguggaagcgccagcucaaccagcugagcaagagcgaguucaacaccuacaagcgguccgggaucauggagguggaccgcagcgaggcgaaggagggccugaagcgcggggagaccacgaagcacgccgucucccgcggcaccgccaagcuccggugguucguggagcgcaaccuggugaagcccgagggcaaggucaucgaccuggggugcggccgcgggggcuggagcuacuacugcgccgggcugaagaaggugaccgaggugaagggcuacaccaagggcgggcccggccacgaggagccgauccccauggccaccuacggguggaaccucgucaagcugcacuccggcaaggacguguucuucaugccgcccgagaagugcgacacgcugcucugcgacaucggggagagcuccccgaaccccaccaucgaggagggccgcacccugcgggugcugaagauggucgagcccuggcuccgcggcaaccaguucugcaucaagauccugaaccccuacaugccgagcgugguggagacccuggagcggaugcagcgcaagcacgggggcaugcucguccggaacccccugucccgcaacagcacgcacgagauguacuggguguccugcgggaccggcaacaucgugagcgcggucaacaugaccucccgcaugcugcucaaccgguucaccauggcccaccgcaagcccacguacgagcgggacguggaccugggcgccgggacccgccacguggccgucgagcccgagguggccaaccuggacaucaucggccagcggaucgagaacaucaagaacgagcacaagagcaccuggcacuacgacgaggacaacccguacaagaccugggcguaccacggguccuacgaggugaagcccagcggcuccgccagcuccauggucaacggggugguccgccuccugacgaagcccugggacgugauccccauggugacccagaucgccaugaccgacaccacgccguucggccagcagcgggucuucaaggagaagguggacacccgcacgccccgggccaagcgcggcaccacgcagaucauggaggugaccgccaaguggcuguggggguuccucagccggaacaagaagccccgcaucugcacccgggaggaguucacccgcaagguccggagcaacgcggccaucggcgccguguucguggacgagaaccaguggaacuccgccaaggaggcggucgaggacgagcgcuucugggaccuggugcaccgggagcgcgagcugcacaagcaggggaagugcgccacgugcguguacaacaugaugggcaagcgggagaagaagcucggggaguucggcaaggccaagggcagccgcgccaucugguacauguggcugggggcccgguuccuggaguucgaggcgcucggcuucaugaacgaggaccacugguucucccgcgagaacagccuguccggggucgagggcgaggggcugcacaagcucggcuacauccugcgcgacaucagcaagaucccgggcgggaacauguacgccgacgacaccgccggcugggacacccgggugaccgaggacgaccugcagaacgaggccaagaucacggacaucauggagcccgagcacgcccuccuggcgaccuccaucuucaagcugaccuaccagaacaaggugguccgcgugcagcggcccgccaagaacgggaccgugauggacgucaucagccgccgggaccagcgcggcuccggccagguggggacguacggccucaacaccuucaccaacauggaggugcagcugauccggcagauggagagcgaggggaucuuccugcccuccgagcucgagaccccgaaccuggccgagcgcgcccuggacuggcucgagaagcacggcgccgagcggcugaagcgcauggcgaucagcggggacgacugcgucgugaagcccaucgacgaccgguucgccacggcccugaccgcccucaacgacaugggcaaggugcgcaaggacaucccccagugggagcccuccaagggcuggaacgacuggcagcaggucccguucugcagccaccacuuccaccagcugaucaugaaggacgggcgggagaucguggugcccugccgcaaccaggacgagcuggucggccgggcccgcgugucccagggggcgggcuggagccuccgggagaccgccugccuggggaaguccuacgcccagauguggcagcugauguacuuccaccgccgggaccuccgccuggccgcgaacgccaucugcagcgccgugcccgucgacugggugcccaccagccgcaccacgugguccauccacgcccaccaccaguggaugaccaccgaggacaugcugagcguguggaaccgggucuggaucgaggagaacccguggauggagaacaagacccacguguccagcugggaggaggugcccuaccucggcaagcgcgaggaccaguggugcggcucccugaucgggcugacggcccgggcgaccugggccaccaacauccaggucgccaucaaccaggugcgccggcucaucggcaacgagaacuaccuggacuacaugaccagcaugaagcgcuucaagaacgaguccgacagcgagggggcccugugguga

SEQ ID NO: 8182 - RNA, 9879 nt, Artificial Sequence
  derived and/or modified CDS sequence (opt1) from DENV-1__KJ189353__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagaucuucggcaccgccuacggggugcuguucagcggcguguccuggaccaugaagaucgggaucggcauccugcucacguggcugggccugaacagccgguccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcgucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgagcugugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacgcucgccguguuccugcugcucaucaugggccagcugaccuggaacgaccugauccggcucugcaucauggucggggccaacgcguccgaccgcaugggcaugggcaccaccuaccuggcccugauggccacguucaagaugcggccgauguucgccguggggcuccuguuccgccggcugaccagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgucaagaccacgcugucccuggacuacgccuggaagaccaccgccauggcccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcacgaugaagaucaaggacgaggagcgcgacgacacccugaccauccuccugaaggccacccugcucgcggucagcgggguguaccccauguccauccccgccacgcuguucgugugguacuucuggcagaagaagaagcagcggagcggcguccugugggacacccccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacacgggggaggagguccaggugaucgcggucgagcccggcaagaacccgaagaacgugcagaccacccccggcaccuucaagacgcccgagggggaggugggcgccaucgcccucgacuucaagcccgggaccuccggcagcccgaucgucaaccgggagggcaagaucguggggcuguacggcaacgggguggucaccaccuccggcacguacgugagcgccaucgcccaggcgaaggccagccaggaggggccccugcccgagaucgaggacgagguguucaagaagcgcaaccucaccaucauggaccugcacccgggcuccggcaagacccggcgcuaccugcccgccaucguccgggaggccaucaagcgcaagcuccgcacccugauccuggcgcccacgcgggugguggccagcgagauggccgaggcccucaaggggaugcccauccgcuaccagaccaccgccgucaaguccgagcacaccggccgggagaucguggaccugaugugccacgcgacguucaccaugcgccugcucagcccggugcggguccccaacuacaacaugaucaucauggacgaggcccacuucaccgaccccgccuccaucgccgcccgcggguacaucagcacccgggugggcaugggggaggcggccgccaucuucaugacggccacgccgcccggcuccguggaggccuucccccagagcaacgcggucauccaggacgaggagcgcgacauccccgagcgguccuggaacagcggcuacgacuggaucaccgacuuccccgggaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccucaagcccgugauccugaaggacgggcccgagcgggugauccuggcgggcccgaugcccgucaccgccgccuccgccgcccagcgccggggccgcaucgggcgcaaccagaacaaggagggcgaccaguacguguacauggggcagccccucaacaacgacgaggaccacgcgcacuggaccgaggccaagaugcugcuggacaacaucaacacccccgagggcaucaucccggcccucuucgagcccgagcgggagaaguccgccgccaucgacggggaguaccgccugcggggcgaggcgcgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcccggaccuacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacgcugaugcugcucgcccugaucgccgugcugaccggcggggugacccucuucuuccuguccggcaagggccuggggaagaccagcaucggccuccugugcgucacggccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccacgaagaaggaccuggggaucggcuacgucgccgccgagaaccaccagcacgccaccaugcucgacguggaccugcacccggccuccgcguggacccuguacgccguggccaccacggucaucacccccaugaugcggcacaccaucgagaacaccacggccaacaucagccucaccgccaucgcgaaccaggccgccauccugaugggccuggacaagggguggcccaucuccaagauggacaucggcgugccccuccuggcccuggggugcuacagccaggugaacccgcucacccugaccgcggccguccugaugcucguggcccacuacgccaucaucggccccgggcugcaggccaaggcgacgcgcgaggcccagaagcgcaccgccgccggcaucaugaagaaccccaccguggacggcaucgucgccaucgaccuggaccccgugguguacgacgcgaaguucgagaagcagcucgggcagaucaugcugcugauccucugcaccucccagauccugcugaugcggacgaccugggcccucugcgagagcaucacccuggccaccggcccgcugacgacccucugggaggggucccccggcaaguucuggaacaccaccaucgccgucagcauggccaacaucuuccgcggcuccuaccuggcgggggccggccuggccuucagccucaugaagucccucgggggcgggcggcgcggcacgggcgcccagggggagacccugggcgagaaguggaagcggcagcucaaccagcugagcaagagcgaguucaacaccuacaagcgcuccgggaucauggagguggaccggagcgaggcgaaggagggccugaagcgcggggagaccacgaagcacgccgugucccggggcaccgccaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacgcacgagauguacugggucuccugcgggaccggcaacaucgugagcgcggugaacaugaccucccgcaugcugcucaaccgcuucaccauggcccaccggaagcccacguacgagcgcgacgucgaccugggcgccgggacccggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcuccugacgaagcccugggacgucauccccauggugacccagaucgccaugaccgacaccacgccguucggccagcagcgcguguucaaggagaaggucgacacccggacgccccgcgccaagcggggcaccacgcagaucauggaggugaccgccaaguggcuguggggguuccucagccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgccacgugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagaucccgggcgggaacauguacgccgacgacaccgccggcugggacacccgcgucaccgaggacgaccugcagaacgaggccaagaucacggacaucauggagcccgagcacgcccuccuggcgaccuccaucuucaagcugaccuaccagaacaagguggugcggguccagcgccccgccaagaacgggaccgugauggacgugaucagccggcgcgaccagcggggcuccggccaggucgggacguacggccucaacaccuucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggcgaucagcggggacgacugcguggucaagcccaucgacgaccgcuucgccacggcccugaccgcccucaacgacaugggcaaggugcggaaggacaucccccagugggagcccuccaagggcuggaacgacuggcagcaggucccguucugcagccaccacuuccaccagcugaucaugaaggacgggcgcgagaucgucgugcccugccggaaccaggacgagcuggugggccgcgcccgggucucccagggggcgggcuggagccuccgcgagaccgccugccuggggaaguccuacgcccagauguggcagcugauguacuuccaccggcgcgaccuccggcuggccgcgaacgccaucugcagcgccgugcccguggacuggguccccaccagccgcaccacgugguccauccacgcccaccaccaguggaugaccaccgaggacaugcugagcguguggaaccgcguguggaucgaggagaacccguggauggagaacaagacccacgucuccagcugggaggaggugcccuaccucggcaagcgggaggaccaguggugcggcucccugaucgggcugacggcccgcgcgaccugggccaccaacauccagguggccaucaaccagguccggcgccucaucggcaacgagaacuaccuggacuacaugaccagcaugaagcgguucaagaacgaguccgacagcgagggggcccugugguga

SEQ ID NO: 8183 - RNA, 9879 nt, Artificial Sequence
  derived and/or modified CDS sequence (opt1) from DENV-1__KJ189354__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagaucuucggcaccgccuacggggugcuguucagcggcguguccuggaccaugaagaucgggaucggcauccugcucacguggcugggccugaacagccgguccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcgucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacgcucgccguguuccugcugcucaucaugggccagcugaccuggaacgaccugauccggcucugcaucauggucggggccaacgcguccgaccgcaugggcaugggcaccaccuaccuggcccugauggccacguucaagaugcggccgauguucgccguggggcuccuguuccgccggcugaccagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgucaagaccacgcugucccuggacuacgccuggaagaccaccgccauggcccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcacgaugaagaucaaggacgaggagcgcgacgacacccugaccauccuccugaaggccacccugcucgcggucagcgggguguaccccauguccauccccgccacgcuguucgugugguacuucuggcagaagaagaagcagcggagcggcguccugugggacacccccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacacgggggaggagguccaggugaucgcggucgagcccggcaagaacccgaagaacgugcagaccacccccggcaccuucaagacgcccgagggggaggugggcgccaucgcccucgacuucaagcccgggaccuccggcagcccgaucgucaaccgggagggcaagaucguggggcuguacggcaacgggguggucaccaccuccggcacguacgugagcgccaucgcccaggcgaaggccagccaggaggggccccugcccgagaucgaggacgagguguucaagaagcgcaaccucaccaucauggaccugcacccgggcuccggcaagacccggcgcuaccugcccgccaucguccgggaggccaucaagcgcaagcuccgcacccugauccuggcgcccacgcgggugguggccagcgagauggccgaggcccucaaggggaugcccauccgcuaccagaccaccgccgucaaguccgagcacaccggccgggagaucguggaccugaugugccacgcgacguucaccaugcgccugcucagcccggugcggguccccaacuacaacaugaucaucauggacgaggcccacuucaccgaccccgccuccaucgccgcccgcggguacaucagcacccgggugggcaugggggaggcggccgccaucuucaugacggccacgccgcccggcuccguggaggccuucccccagagcaacgcggucauccaggacgaggagcgcgacauccccgagcgguccuggaacagcggcuacgacuggaucaccgacuuccccgggaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccucaagcccgugauccugaaggacgggcccgagcgggugauccuggcgggcccgaugcccgucaccgccgccuccgccgcccagcgccggggccgcaucgggcgcaaccagaacaaggagggcgaccaguacguguacauggggcagccccucaacaacgacgaggaccacgcgcacuggaccgaggccaagaugcugcuggacaacaucaacacccccgagggcaucaucccggcccucuucgagcccgagcgggagaaguccgccgccaucgacggggaguaccgccugcggggcgaggcgcgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcccggaccuacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacgcugaugcugcucgcccugaucgccgugcugaccggcggggugacccucuucuuccuguccggcaagggccuggggaagaccagcaucggccuccugugcgucacggccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccacgaagaaggaccuggggaucggcuacgucgccgccgagaaccaccagcacgccaccaugcucgacguggaccugcacccggccuccgcguggacccuguacgccguggccaccacggucaucacccccaugaugcggcacaccaucgagaacaccacggccaacaucagccucaccgccaucgcgaaccaggccgccauccugaugggccuggacaagggguggcccaucuccaagauggacaucggcgugccccuccuggcccuggggugcuacagccaggugaacccgcucacccugaccgcggccguccugaugcucguggcccacuacgccaucaucggccccgggcugcaggccaaggcgacgcgcgaggcccagaagcgcaccgccgccggcaucaugaagaaccccaccguggacggcaucgucgccaucgaccuggaccccgugguguacgacgcgaaguucgagaagcagcucgggcagaucaugcugcugauccucugcaccucccagauccugcugaugcggacgaccugggcccucugcgagagcaucacccuggccaccggcccgcugacgacccucugggaggggucccccggcaaguucuggaacaccaccaucgccgucagcauggccaacaucuuccgcggcuccuaccuggcgggggccggccuggccuucagccucaugaagucccucgggggcgggcggcgcggcacgggcgcccagggggagacccugggcgagaaguggaagcggcagcucaaccagcugagcaagagcgaguucaacaccuacaagcgcuccgggaucauggagguggaccggagcgaggcgaaggagggccugaagcgcggggagaccacgaagcacgccgugucccggggcaccgccaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacgcacgagauguacugggucuccugcgggaccggcaacaucgugagcgcggugaacaugaccucccgcaugcugcucaaccgcuucaccauggcccaccggaagcccacguacgagcgcgacgucgaccugggcgccgggacccggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcuccugacgaagcccugggacgucauccccauggugacccagaucgccaugaccgacaccacgccguucggccagcagcgcguguucaaggagaaggucgacacccggacgccccgcgccaagcggggcaccacgcagaucauggaggugaccgccaaguggcuguggggguuccucagccgcaacaagaagccccggaucugcacccgcgaggaguucacccggaaggugcgcagcaacgcggccaucggcgccgucuucguggacgagaaccaguggaacuccgccaaggaggcgguggaggacgagaaguucugggaccugguccaccgggagcgcgagcugcacaagcaggggaagugcgccacgugcguguacaacaugaugggcaagcgggagaagaagcucggggaguucggcaaggccaagggcagccgcgccaucugguacauguggcugggggcccgguuccuggaguucgaggcgcucggcuucaugaacgaggaccacugguucucccgcgagaacagccuguccgggguggagggcgaggggcugcacaagcucggcuacauccugcgggacaucagcaagaucccgggcgggaacauguacgccgacgacaccgccggcugggacacccgcgucaccgaggacgaccugcagaacgaggccaagaucacggacaucauggagcccgagcacgcccuccuggcgaccuccaucuucaagcugaccuaccagaacaagguggugcgcguccagcggcccgccaagaacgggaccgugauggacgugaucagccgccgggaccagcgcggcuccggccaggucgggacguacggccucaacaccuucaccaacauggaggugcagcugauccggcagauggagagcgaggggaucuuccugcccuccgagcucgagaccccgaaccuggccgagcgcgcccuggacuggcucgagaagcacggcgccgagcggcugaagcgcauggcgaucagcggggacgacugcguggucaagcccaucgacgaccgguucgccacggcccugaccgcccucaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcuggugggccgggcccgcgucucccagggggcgggcuggagccuccgggagaccgccugccuggggaaguccuacgcccagauguggcagcugauguacuuccaccgccgggaccuccgccuggccgcgaacgccaucugcagcgccgugcccguggacuggguccccaccagccggaccacgugguccauccacgcccaccaccaguggaugaccaccgaggacaugcugagcguguggaaccgcguguggaucgaggagaacccguggauggagaacaagacccacgucuccagcugggaggaggugcccuaccucggcaagcgcgaggaccaguggugcggcucccugaucgggcugacggcccgggcgaccugggccaccaacauccagguggccaucaaccagguccgccggcucaucggcaacgagaacuaccuggacuacaugaccagcaugaagcgcuucaagaacgaguccgacagcgagggggcccugugguga

SEQ ID NO: 8184 - RNA, 9879 nt, Artificial Sequence
  derived and/or modified CDS sequence (opt1) from DENV-1__KJ189355__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaucgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacaccgcgugggacuucgggagcaucggcggcguguucacguccguggggaagcucguccaccagaucuucggcaccgccuacggggugcuguucagcggcguguccuggaccaugaagaucgggaucggcauccugcucaccuggcugggccugaacagccgguccaugagccucuccaugacgugcaucgccgucgggauggugacccuguaccugggcgugaugguccaggccgacagcgggugcgugaucaacuggaagggccgcgagcucaagugcggguccggcaucuucgugaccaacgagguccacaccuggacggagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacaccaccuucaucaucgacgggcccgacacgccggagugccccgacggccagcgggccuggaacaucugggagguggaggacuacggguucggcgucuucaccaccaacaucuggcugaagcugcgcgacuccuacacccagaugugcgaccaccggcucaugagcgcggccaucaaggacuccaaggccgugcacgccgacaugggcuacuggaucgagagcgagaagaacgagacguggaagcuggcccgcgcguccuucaucgaggugaagaccugcaccuggcccaagagccacacccugugguccaacgggguccucgagagcgagaugaucauccccaagaucuacggcgggccgaucucccagcacaacuaccggcccggcuacuucacgcagaccgccgggcccuggcaccugggcaagcuggagcucgacuucgaccugugcgagggcaccaccgugguggucgacgagcacugcgggaaccgcggcccgagccugcggacgaccaccgugaccgggaagaucauccacgaguggugcugccgcuccugcacgcugccgccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacccucgccguguuccugcugcucaucaugggccagcugaccuggaacgaccugauccggcucugcaucauggucggggccaacgcguccgaccgcaugggcaugggcacgaccuaccuggcccugauggccaccuucaagaugcggccgauguucgccguggggcuccuguuccgccggcugaccagccgcgaggugcuccugcugacgaucggccucucccuggucgccagcguggagcugcccaacucccucgaggagcugggggacggccuggcgaugggcaucaugaugcucaagcugcugaccgaguuccagccccaccagcucuggaccacccugcugagccucacguucgucaagaccacccugucccuggacuacgccuggaagaccacggccauggcccucagcaucgugucccuguucccccugugccucagcaccaccucccagaagaccacguggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcaccaugaagaucaaggacgaggagcgcgacgacacccugacgauccuccugaaggccacccugcucgcggucagcgggguguaccccauguccauccccgccacccuguucgugugguacuucuggcagaagaagaagcagcggagcggcguccugugggacacccccuccccgcccgagguggagcgcgccgugcucgacaacggcaucuaccggauccugcagcgcgggcugcugggccggagccaggucggggugggcguguuccaggacggggucuuccacacgauguggcacgugacccgcggcgccgugcucauguaccagggcaagcggcuggagcccuccugggccagcgucaagaaggaccugaucuccuacgggggcggguggcgcuuccagggcagcuggaacaccggggaggagguccaggugaucgcggucgagcccggcaagaacccgaagaacgugcagaccacgcccggcaccuucaagacccccgagggggaggugggcgccaucgcccucgacuucaagcccgggaccuccggcagcccgaucgucaaccgggagggcaagaucguggggcuguacggcaacgggguggucacgaccuccggcaccuacgugagcgccaucgcccaggcgaaggccagccaggaggggccccugcccgagaucgaggacgagguguucaagaagcgcaaccucaccaucauggaccugcacccgggcuccggcaagacgcggcgcuaccugcccgccaucguccgggaggccaucaagcgcaagcuccgcacccugauccuggcgcccacccgggugguggccagcgagauggccgaggcccucaaggggaugcccauccgcuaccagaccacggccgucaaguccgagcacaccggccgggagaucguggaccugaugugccacgcgaccuucaccaugcgccugcucagcccggugcggguccccaacuacaacaugaucaucauggacgaggcccacuucacggaccccgccuccaucgccgcccgcggguacaucagcacccgggugggcaugggggaggcggccgccaucuucaugaccgccacgccgcccggcuccguggaggccuucccccagagcaacgcggucauccaggacgaggagcgcgacauccccgagcgguccuggaacagcggcuacgacuggaucacggacuuccccgggaagaccgugugguucgugcccuccaucaagagcggcaacgacaucgccaacugccugcgcaagaacgggaagcgggucauccagcugucccgcaagaccuucgacaccgaguaccagaagacgaagaacaacgacugggacuacguggugaccaccgacaucagcgagaugggcgccaacuuccgggccgaccgcgucaucgacccccggcgcugccucaagcccgugauccugaaggacgggcccgagcgggugauccuggcgggcccgaugcccgucaccgccgccuccgccgcccagcgccggggccgcaucgggcgcaaccagaacaaggagggcgaccaguacguguacauggggcagccccucaacaacgacgaggaccacgcgcacuggacggaggccaagaugcugcuggacaacaucaacacccccgagggcaucaucccggcccucuucgagcccgagcgggagaaguccgccgccaucgacggggaguaccgccugcggggcgaggcgcgcaagaccuucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcccggacguacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacccugaugcugcucgcccugaucgccgugcugaccggcggggugacccucuucuuccuguccggcaagggccuggggaagaccagcaucggccuccugugcgucaccgccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugacgguggccgcgaacgagaugggccuccuggagaccaccaagaaggaccuggggaucggcuacgucgccgccgagaaccaccagcacgccaccaugcucgacguggaccugcacccggccuccgcguggacgcuguacgccguggccaccaccgucaucacccccaugaugcggcacacgaucgagaacaccaccgccaacaucagccucaccgccaucgcgaaccaggccgccauccugaugggccuggacaagggguggcccaucuccaagauggacaucggcgugccccuccuggcccuggggugcuacagccaggugaacccgcucacgcugaccgcggccguccugaugcucguggcccacuacgccaucaucggccccgggcugcaggccaaggcgacccgcgaggcccagaagcgcaccgccgccggcaucaugaagaaccccacgguggacggcaucgucgccaucgaccuggaccccgugguguacgacgcgaaguucgagaagcagcucgggcagaucaugcugcugauccucugcaccucccagauccugcugaugcggaccaccugggcccucugcgagagcaucacgcuggccaccggcccgcugaccacccucugggaggggucccccggcaaguucuggaacacgaccaucgccgucagcauggccaacaucuuccgcggcuccuaccuggcgggggccggccuggccuucagccucaugaagucccucgggggcgggcggcgcggcaccggcgcccagggggagacccugggcgagaaguggaagcggcagcucaaccagcugagcaagagcgaguucaacacguacaagcgcuccgggaucauggagguggaccggagcgaggcgaaggagggccugaagcgcggggagaccaccaagcacgccgugucccggggcaccgccaagcuccgcugguucgucgagcggaaccuggugaagcccgagggcaaggugaucgaccuggggugcggccgcgggggcuggagcuacuacugcgccgggcugaagaaggucacggaggugaagggcuacaccaagggcgggcccggccacgaggagccgauccccauggccaccuacggguggaaccucgugaagcugcacuccggcaaggacgucuucuucaugccgcccgagaagugcgacacccugcucugcgacaucggggagagcuccccgaaccccaccaucgaggagggccggacgcugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacccacgagauguacugggucuccugcgggaccggcaacaucgugagcgcggugaacaugacgucccgcaugcugcucaaccgcuucaccauggcccaccggaagcccaccuacgagcgcgacgucgaccugggcgccgggacccggcacguggccguggagcccgaggucgccaaccuggacaucaucggccagcgcaucgagaacaucaagaacgagcacaagagcacguggcacuacgacgaggacaacccguacaagaccugggcguaccacggguccuacgaggugaagcccagcggcuccgccagcuccauggugaacggggucgugcggcuccugaccaagcccugggacgucauccccauggugacccagaucgccaugacggacaccaccccguucggccagcagcgcguguucaaggagaaggucgacacccggacgccccgcgccaagcggggcaccacccagaucauggaggugaccgccaaguggcuguggggguuccucagccgcaacaagaagccccggaucugcacgcgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgcgaccugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagaucccgggcgggaacauguacgccgacgacaccgccggcugggacacgcgcgucaccgaggacgaccugcagaacgaggccaagaucaccgacaucauggagcccgagcacgcccuccuggcgaccuccaucuucaagcugacguaccagaacaagguggugcggguccagcgccccgccaagaacgggaccgugauggacgugaucagccggcgcgaccagcggggcuccggccaggucgggaccuacggccucaacaccuucacgaacauggaggugcagcugauccgccagauggagagcgaggggaucuuccugcccuccgagcucgagaccccgaaccuggccgagcgggcccugggcuggcucgagaagcacggggccgagcgccugaagcggauggcgaucagcggcgacgacugcguggucaagcccaucgacgaccgcuucgccaccgcccugaccgcccucaacgacaugggcaaggugcggaaggacaucccccagugggagcccuccaagggguggaacgacuggcagcaggucccguucugcagccaccacuuccaccagcugaucaugaaggacggccgcgagaucgucgugcccugccggaaccaggacgagcugguggggcgcgcccgggucucccagggcgcgggguggagccuccgcgagacggccugccugggcaaguccuacgcccagauguggcagcugauguacuuccaccggcgcgaccuccggcuggccgcgaacgccaucugcagcgccgugcccguggacuggguccccaccagccgcaccaccugguccauccacgcccaccaccaguggaugaccacggaggacaugcugagcguguggaaccgcguguggaucgaggagaacccguggauggagaacaagacccacgucuccagcugggaggaggugcccuaccucggcaagcgggaggaccaguggugcgggucccugaucggccugaccgcccgcgcgaccugggccacgaacauccagguggccaucaaccagguccggcgccucaucgggaacgagaacuaccuggacuacaugaccagcaugaagcgguucaagaacgaguccgacagcgagggcgcccugugguga

SEQ ID NO: 8185 - RNA, 9879 nt, Artificial Sequence
  derived and/or modified CDS sequence (opt1) from DENV-1__KJ189358__SS-prME
agcgugaccaugcugcucaugcugcugcccaccgugcucgccuuccaccugaccacccgcggcggggagccccacaugaucgugagcaagcaggagcggggcaagagccuccuguucaagaccagcgccggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgucggccuggggcucgagacccgcaccgagaccuggaugagcuccgagggcgccuggaagcagauccagcggguggagaccugggcccugcgccaccccggguucacggugaucgccuucuuccuggcccacgcgaucggcaccagcaucacccagaaggggaucaucuucauccuccugaugcuggucacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcgcgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccacccaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagcccuaccagcucuggacgacccugcugagccucaccuucgugaagaccacgcugucccuggacuacgcguggaagaccaccgccauggcccucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacuccauccuggucgaggugcaggacgacggcacgaugaagaucaaggacgaggagcgcgacgacacccugaccauccuccugaaggccacccugcucgccgugagcggggucuaccccauguccauccccgcgacgcuguucgugugguacuucuggcagcggaagaagcagcgcagcggcgugcugugggacacccccuccccgcccgaggucgagcgggccgugcucgacaacggcaucuaccgcauccugcagcgggggcugcugggccgcagccaggugggggucggcguguuccaggacgggguguuccacaccauguggcacgucacccggggcgccgugcucauguaccagggcaagcgccuggagcccuccugggccagcgugaagaaggaccugaucuccuacgggggcggguggcgguuccagggcagcuggaacacgggggaggagguccaggugaucgccguggagcccggcaagaacccgaagaacguccagaccacccccggcaccuucaagacgcccgagggggaggugggcgcgaucgcccucgacuucaagcccgggaccuccggcagcccgaucgugaaccgcgagggcaagaucgucgggcuguacggcaacgggguggugaccaccuccggcacguacgucagcgccaucgcccaggccaaggcgagccaggaggggccccugcccgagaucgaggacgagguguucaagaagcggaaccucaccaucauggaccugcacccgggcuccggcaagacccgcaaguaccugcccgccaucgugcgggaggccaucaagcgcaagcuccgcacccugauccuggcccccacgcgggucguggcgagcgagauggccgaggcccucaaggggaugcccauccgcuaccagaccaccgccgugaaguccgagcacaccggccgggagaucgucgaccugaugugccacgccacguucaccaugcgccugcucagcccggugcgggugcccaacuacaacaugaucaucauggacgaggcgcacuucaccgaccccgccuccaucgccgcccgcggguacaucagcacccgggucggcaugggggaggccgcggccaucuucaugacggccacgccgcccggcuccguggaggccuucccccagagcaacgccgugauccaggacgaggagcgcgacauccccgagcgguccuggaacagcggcuacgacuggaucaccgacuuccccgggaagaccgucugguucgugcccuccaucaagagcggcaacgacaucgcgaacugccugcgcaagaacgggaagcgggugauccagcugucccgcaagacguucgacaccgaguaccagaagaccaagaacaacgacugggacuacgucgugaccacggacaucagcgagaugggcgccaacuuccgggccgaccgcgugaucgacccccggcgcugccucaagcccgucauccugaaggacgggcccgagcgggugauccuggccggcccgaugcccgucaccguggcguccgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcgcggaccuacagcgacccgcuggcccuccgcgaguucaaggaguucgccgccggccggcgcagcguguccggcgaccugauccuggagaucgggaagcucccccagcaccugacccugcgggcccagaacgcgcucgacaaccuggucaugcugcacaacagcgagcagggcgggaaggccuaccgccacgccauggaggagcuccccgacaccaucgagacgcugaugcugcucgcccugaucgcggugcugaccggcggggugacccucuucuuccuguccggcaagggccuggggaagaccagcaucggccuccugugcgucacggccuccagcgcccugcucuggauggccuccguggagccccacuggaucgccgcgagcaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccuccgccuggacccuguacgccguggcgaccacggucaucacccccaugaugcggcacaccaucgagaacaccacggccaacaucagccucaccgccaucgccaaccaggccgcgauccugaugggccuggacaagggguggcccaucuccaagauggacaucggcgugccccuccuggcccuggggugcuacagccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccucccagauccugcugaugcggacgaccugggcccucugcgagagcaucacccuggcgaccggcccgcugacgacccucugggaggggucccccggcaaguucuggaacaccaccaucgccgucagcauggccaacaucuuccgcggcuccuaccuggccggggccggccuggcguucagccucaugaagucccucgggggcgggcggcgcggcacgggcgcccagggggagacccugggcgagaaguggaagcggcagcucaaccagcugagcaagagcgaguucaacaccuacaagcgcuccgggaucauggagguggaccggagcgaggccaaggagggccugaagcgcggggagaccacgaagcacgccgugucccggggcaccgcgaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacgcacgagauguacugggucuccugcgggaccggcaacaucgugagcgccgugaacaugaccucccgcaugcugcucaaccgcuucaccauggcccaccggaagcccacguacgagcgcgacgucgaccugggcgcggggacccggcacguggccguggagcccgaggucgccaaccuggacaucaucggccagcgcaucgagaacaucaagaacgagcacaagagcaccuggcacuacgacgaggacaacccguacaagaccugggccuaccacggguccuacgaggugaagcccagcggcuccgccagcuccauggucaacgggguggugcggcuccugacgaagcccugggacgucauccccauggugacccagaucgcgaugaccgacaccacgccguucggccagcagcgcguguucaaggagaaggucgacacccggacgccccgcgccaagcggggcaccacgcagaucauggaggugaccgccaaguggcuguggggguuccucagccgcaacaagaagccccggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcagccgggccaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgccgacgacaccgcgggcugggacacccgcaucaccgaggacgaccugcagaacgaggccaagaucacggacaucauggagcccgagcacgcccagcucgccaccuccaucuucaagcugaccuaccagaacaaggucgugcgggugcagcgccccgccaagaacgggaccgucauggacgugaucagccggcgcgaccagcggggcuccggccagguggggacguacggccugaacaccuucaccaacauggagguccagcucauccgccagauggagagcgaggggaucuuccugcccuccgagcuggagaccccgaaccucgcggagcgggcccuggacuggcuggagaagaacggcgccgagcgccucaagcggauggccaucagcggggacgacugcguggugaagcccaucgacgaccgcuucgccacggcgcugaccgcccugaacgacaugggcaagguccggaaggacaucccccagugggagcccuccaagggcuggaacgacuggcagcaggucccguucugcagccaccacuuccaccagcucaucaugaaggacgggcgcgagaucgugguccccugccggaaccaggacgagcuggugggccgcgcccgggugucccagggggccggcuggagccugcgcgagaccgccugccucgggaaguccuacgcgcagauguggcagcugauguacuuccaccggcgcgaccugcggcucgccgccaacgccaucugcagcgcgguccccguggacugggugcccaccagccgcaccacgugguccauccacgcccaccaccaguggaugaccaccgaggacaugcugagcgucuggaaccgcguguggaucgaggagaacccguggauggaggacaagacccacguguccagcugggaggagguccccuaccugggcaagcgggaggaccaguggugcggcucccucaucgggcugacggcccgcgccaccugggccaccaacauccagguggcgaucaaccaggugcggcgccugaucggcaacgagaacuaccucgacuacaugaccagcaugaagcgguucaagaacgaguccgacagcgagggggcccugugguga

SEQ ID NO: 8186 - RNA, 9879 nt, Artificial Sequence
  derived and/or modified CDS sequence (opt1) from DENV-1__KJ189359__SS-prME
agcgugaccaugcugcucaugcugcugcccaccgugcucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgggagaagcgguccguggcccuggcgccccacgucggccuggggcucgagacccgcaccgagaccuggaugagcuccgagggcgccuggaagcagauccagcggguggagaccugggcccugcgccaccccggguucacggugaucgccuucuuccuggcccacgcgaucggcaccagcaucacccagaaggggaucaucuucauccuccugaugcuggucacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcgcgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagccccaccagcucuggacgacccugcugagccucaccuucgugaagaccacgcugucccuggacuacgcguggaagaccaccgccauggcccucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacuccauccuggucgaggugcaggacgacggcacgaugaagaucaaggacgaggagcgcgacgacacccugaccauccuccugaaggccacccugcucgccgugagcggggucuaccccauguccauccccgcgacgcuguucgugugguacuucuggcagcggaagaagcagcgcagcggcgugcugugggacacccccuccccgcccgaggucgagcgggccgugcucgacaacggcaucuaccgcauccugcagcgggggcugcugggccgcagccaggugggggucggcguguuccaggacgggguguuccacaccauguggcacgucacccggggcgccgugcucauguaccagggcaagcgccuggagcccuccugggccagcgugaagaaggaccugaucuccuacgggggcggguggcgguuccagggcagcuggaacacgggggaggagguccaggugaucgccguggagcccggcaagaacccgaagaacguccagaccacccccggcaccuucaagacgcccgagggggaggugggcgcgaucgcccucgacuucaagcccgggaccuccggcagcccgaucgugaaccgcgagggcaagaucgucgggcuguacggcaacgggguggugaccaccuccggcacguacgucagcgccaucgcccaggccaaggcgagccaggaggggccccugcccgagaucgaggacgagguguucaagaagcggaaccucaccaucauggaccugcacccgggcuccggcaagacccgccgguaccugcccgccaucgugcgcgaggccaucaagcgcaagcuccggacccugauccuggcccccacgcgcgucguggcgagcgagauggccgaggcccucaaggggaugcccauccgguaccagaccaccgccgugaaguccgagcacaccggccgcgagaucgucgaccugaugugccacgccacguucaccaugcggcugcucagcccggugcgcgugcccaacuacaacaugaucaucauggacgaggcgcacuucaccgaccccgccuccaucgccgcccggggguacaucagcacccgcgucggcaugggggaggccgcggccaucuucaugacggccacgccgcccggcuccguggaggccuucccccagagcaacgccgugauccaggacgaggagcgggacauccccgagcgcuccuggaacagcggcuacgacuggaucaccgacuuccccgggaagaccgucugguucgugcccuccaucaagagcggcaacgacaucgcgaacugccugcggaagaacgggaagcgcgugauccagcugucccggaagacguucgacaccgaguaccagaagaccaagaacaacgacugggacuacgucgugaccacggacaucagcgagaugggcgccaacuuccgcgccgaccgggugaucgacccccgccggugccucaagcccgucauccugaaggacgggcccgagcgcgugauccuggccggcccgaugcccgucaccguggcguccgccgcccagcggcgcggccgcaucgggcggaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucgucgagcugaugcgccggggcgaccuccccguguggcuguccuacaagguggccagcgagggguuccaguacuccgaccgccgguggugcuucgacggcgagcgcaacaaccagguccuggaggagaacauggacguggagaucuggaccaaggagggggagcggaagaagcuccgcccccgguggcuggacgcgcgcaccuacagcgacccgcuggcccuccgggaguucaaggaguucgccgccggccgccggagcguguccggcgaccugauccuggagaucgggaagcucccccagcaccugacccugcgcgcccagaacgcgcucgacaaccuggucaugcugcacaacagcgagcagggcgggaaggccuaccggcacgccauggaggagcuccccgacaccaucgagacgcugaugcugcucgcccugaucgcggugcugaccggcggggugacccucuucuuccuguccggcaagggccuggggaagaccagcaucggccuccugugcgucacggccuccagcgcccugcucuggauggccuccguggagccccacuggaucgccgcgagcaucauccuggaguucuuccugauggugcuccugaucccggagcccgaccgccagcggacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacaccaccaugcucgacguggaccugcacccggccuccgccuggacccuguacgccguggccacgaccgucaucacccccaugaugcgccacaccaucgagaacacgaccgcgaacaucagccucaccgccaucgccaaccaggccgccauccugaugggccuggacaagggguggcccaucuccaagaucgacaucggcgugccccuccuggcgcuggggugcuacagccaggugaacccgcucacccugacggccgccguccugaugcucguggcccacuacgcgaucaucggccccgggcugcaggccaaggccacccgcgaggcccagaagcggaccgccgcgggcaucaugaagaaccccaccguggacggcaucgucgccaucgaccuggaccccgugguguacgacgccaaguucgagaagcagcucgggcagaucaugcugcugauccucugcacgucccagauccugcugaugcgcaccaccugggcccucugcgagagcaucacccuggccacgggcccgcugaccacccucugggaggggucccccggcaaguucuggaacaccacgaucgcggucagcauggccaacaucuuccggggcuccuaccuggccggggccggccuggccuucagccucaugaagucccucgggggcgggcgccgggggaccggcgcgcagggggagacccugggcgagaaguggaagcgccagcucaaccagcugagcaagagcgaguucaacaccuacaagcgguccgggaucauggagguggaccgcagcgaggccaaggagggccugaagcgcggggagacgaccaagcacgccgugucccgcggcaccgccaagcuccggugguucgucgagcgcaaccuggugaagcccgagggcaaggugaucgaccuggggugcggccgcgggggcuggagcuacuacugcgcggggcugaagaaggucaccgaggugaagggcuacaccaagggcgggcccggccacgaggagccgauccccauggccacguacggguggaaccucgugaagcugcacuccggcaaggacgucuucuucaugccgcccgagaagugcgacacccugcucugcgacaucggggagagcuccccgaaccccaccaucgaggagggccgcacccugcgggugcugaagaugguggagcccuggcuccgcggcaaccaguucugcaucaagauccugaaccccuacaugccgagcgucguggagacgcuggagcggaugcagcgcaagcacgggggcaugcucgugcggaacccccugucccgcaacagcacccacgagauguacugggucuccugcgggaccggcaacaucgugagcgccgugaacaugaccucccgcaugcugcucaaccgguucacgauggcccaccgcaagcccaccuacgagcgggacgucgaccugggcgccgggacccgccacguggcgguggagcccgaggucgccaaccuggacaucaucggccagcggaucgagaacaucaagaacgagcacaagagcaccuggcacuacgacgaggacaacccguacaagacgugggccuaccacggguccuacgaggugaagcccagcggcuccgccagcuccauggucaacgggguggugcgccuccugaccaagcccugggacgucauccccauggugacccagaucgccaugaccgacacgaccccguucggccagcagcggguguucaaggagaaggucgacacccgcacgccccgggcgaagcgcggcacgacccagaucauggaggugaccgccaaguggcuguggggguuccucagccggaacaagaagccccgcaucugcacccgggaggaguucacgcgcaaggugcggagcaacgccgccaucggcgccgucuucguggacgagaaccaguggaacaccgcgaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcgggguggagggcgaggggcugcacaagcucggcuacauccugcgcgacaucuccaagaucccgggcgggaacauguacgccgacgacaccgccggcugggacacgcggaucaccgaggacgaccugcagaacgaggcgaagaucaccgacaucauggagcccgagcacgcccuccuggccaccagcaucuucaagcugacguaccagaacaaggucgugcgcgugcagcggcccgccaagaacgggaccgucauggacgugaucucccgccgggaccagcgcggcagcggccagguggggaccuacggccucaacaccuucacgaacauggagguccagcugauccggcagauggaguccgaggggaucuuccugcccagcgagcucgagaccccgaaccuggccgagcgcgcgcuggacuggcucgagaagcacggcgccgagcggcugaagcgcauggccaucuccggggacgacugcguggugaagcccaucgacgaccgguucgccaccgcccugaccgcgcucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcccgcgugagccagggggccggcuggucccuccgggagaccgccugccugggcaagagcuacgcccagauguggcagcugauguacuuccaccgccgggaccuccgccuggcggccaacgccaucugcuccgccguccccguggacugggugcccacgagccgcaccaccuggagcauccacgcgcaccaccaguggaugaccacggaggacaugcuguccgucuggaaccggguguggaucgaggagaacccguggauggaggacaagacccacgugagcuccugggaggagguccccuaccucggcaagcgcgaggaccaguggugcggcagccugaucgggcugaccgcccgggccaccugggccacgaacauccagguggccaucaaccaggugcgccggcucaucggcaacgagaacuaccuggacuacaugaccuccaugaagcgcuucaagaacgagagcgacuccgagggggcgcugugguga

SEQ ID NO: 8187 - RNA, 9879 nt, Artificial Sequence
  derived and/or modified CDS sequence (opt1) from DENV-1__KJ189360__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagaucuucggcaccgccuacggggugcuguucagcggcguguccuggaccaugaagaucgggaucggcauccugcucacguggcugggccugaacagccgguccaccagccucuccaugaccugcaucgccgucgggauggugacccuguaccugggcgugaugguccaggccgacagcgggugcgugaucaacuggaagggccgcgagcucaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcgucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacgcucgccguguuccugcugcucaucaugggccagcugaccuggaacgaccugauccggcucugcaucauggucggggccaacgcguccgaccgcaugggcaugggcaccaccuaccuggcccugauggccacguucaagaugcggccgauguucgccguggggcuccuguuccgccggcugaccagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgucaagaccacgcugucccuggacuacgccuggaagaccaccgccauggcccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcacgaugaagaucaaggacgaggagcgcgacgacacccugaccauccuccugaaggccacccugcucgcggucagcgggguguaccccauguccauccccgccacgcuguucgugugguacuucuggcagaagaagaagcagcggagcggcguccugugggacacccccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacacgggggaggagguccaggugaucgcggucgagcccggcaagaacccgaagaacgugcagaccacccccggcaccuucaagacgcccgagggggaggugggcgccaucgcccucgacuucaagcccgggaccuccggcagcccgaucgucaaccgggagggcaagaucguggggcuguacggcaacgggguggucaccaccuccggcacguacgugagcgccaucgcccaggcgaaggccagccaggaggggccccugcccgagaucgaggacgagguguucaagaagcgcaaccucaccaucauggaccugcacccgggcuccggcaagacccggcgcuaccugcccgccaucguccgggaggccaucaagcgcaagcuccgcacccugauccuggcgcccacgcgggugguggccagcgagauggccgaggcccucaaggggaugcccauccgcuaccagaccaccgccgucaaguccgagcacaccggccgggagaucguggaccugaugugccacgcgacguucaccaugcgccugcucagcccggugcggguccccaacuacaacaugaucaucauggacgaggcccacuucaccgaccccgccuccaucgccgcccgcggguacaucagcacccgggugggcaugggggaggcggccgccaucuucaugacggccacgccgcccggcuccguggaggccuucccccagagcaacgcggucauccaggacgaggagcgcgacauccccgagcgguccuggaacagcggcuacgacuggaucaccgacuuccccgggaagaccgugugguucgugcccuccaucaagagcggcaacgacaucgccaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccucaagcccgugauccugaaggacgggcccgagcgggugauccuggcgggcccgaugcccgucaccgccgccuccgccgcccagcgccggggccgcaucgggcgcaaccagaacaaggagggcgaccaguacguguacauggggcagccccucaacaacgacgaggaccacgcgcacuggaccgaggccaagaugcugcuggacaacaucaacacccccgagggcaucaucccggcccucuucgagcccgagcgggagaaguccgccgccaucgacggggaguaccgccugcggggcgaggcgcgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcccggaccuacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacgcugaugcugcucgcccugaucgccgugcugaccggcggggugacccucuucuuccuguccggcaagggccuggggaagaccagcaucggccuccugugcgucacggccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccacgaagaaggaccuggggaucggcuacgucgccgccgagaaccaccagcacgccaccaugcucgacguggaccugcacccggccuccgcguggacccuguacgccguggccaccacggucaucacccccaugaugcggcacaccaucgagaacaccacggccaacaucagccucaccgccaucgcgaaccaggccgccauccugaugggccuggacaagggguggcccaucuccaagauggacaucggcgugccccuccuggcccuggggugcuacagccaggugaacccgcucacccugaccgcggccguccugaugcucguggcccacuacgccaucaucggccccgggcugcaggccaaggcgacgcgcgaggcccagaagcgcaccgccgccggcaucaugaagaaccccaccguggacggcaucgucgccaucgaccuggaccccgugguguacgacgcgaaguucgagaagcagcucgggcagaucaugcugcugauccucugcaccucccagauccugcugaugcggacgaccugggcccucugcgagagcaucacccuggccaccggcccgcugacgacccucugggaggggucccccggcaaguucuggaacaccaccaucgccgucagcauggccaacaucuuccgcggcuccuaccuggcgggggccggccuggccuucagccucaugaagucccucgggggcgggcggcgcggcacgggcgcccagggggagacccugggcgagaaguggaagcggcagcucaaccagcugagcaagagcgaguucaacaccuacaagcgcuccgggaucauggagguggaccggagcgaggcgaaggagggccugaagcgcggggagaccacgaagcacgccgugucccggggcaccgccaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacgcacgagauguacugggucuccugcgggaccggcaacaucgugagcgcggugaacaugaccucccgcaugcugcucaaccgcuucaccauggcccaccggaagcccacguacgagcgcgacgucgaccugggcgccgggacccggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcuccugacgaagcccugggacgucauccccauggugacccagaucgccaugaccgacaccacgccguucggccagcagcgcguguucaaggagaaggucgacacccggacgccccgcgccaagcggggcaccacgcagaucauggaggugaccgccaaguggcuguggggguuccucagccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgccacgugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagaucccgggcgggaacauguacgccgacgacaccgccggcugggacacccgcgucaccgaggacgaccugcagaacgaggccaagaucacggacaucauggagcccgagcacgcccuccuggcgaccuccaucuucaagcugaccuaccagaacaagguggugcggguccagcgccccgccaagaacgggaccgugauggacgugaucagccggcgcgaccagcggggcuccggccaggucgggacguacggccucaacaccuucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggcgaucagcggggacgacugcguggucaagcccaucgacgaccgcuucgccacggcccugaccgcccucaacgacaugggcaaggugcggaaggacaucccccagugggagcccuccaagggcuggaacgacuggcagcaggucccguucugcagccaccacuuccaccagcugaucaugaaggacgggcgcgagaucgucgugcccugccggaaccaggacgagcuggugggccgcgcccgggucucccagggggcgggcuggagccuccgcgagaccgccugccuggggaaguccuacgcccagauguggcagcugauguacuuccaccggcgcgaccuccggcuggccgcgaacgccaucugcagcgccgugcccguggacuggguccccaccagccgcaccacgugguccauccacgcccaccaccaguggaugaccaccgaggacaugcugagcguguggaaccgcguguggaucgaggagaacccguggauggagaacaagacccacgucuccagcugggaggaggugcccuaccucggcaagcgggaggaccaguggugcggcucccugaucgggcugacggcccgcgcgaccugggccaccaacauccagguggccaucaaccagguccggcgccucaucggcaacgagaacuaccuggacuacaugaccagcaugaagcgguucaagaacgaguccgacagcgagggggcccugugguga

SEQ ID NO: 8188 - RNA, 9879 nt, Artificial Sequence
  derived and/or modified CDS sequence (opt1) from DENV-1__KJ189361__SS-prME
agcgugaccaugcugcucaugcugcugcccaccgccauggccuuccaccucaccacccgcggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccucgcgccccacgugggccuggggcuggagacgcgcaccgagaccuggaugagcuccgagggcgccuggaagcagauccagcggguggagaccugggcccuccgccaccccggguucacggugaucgccuucuuccuggcgcacgccaucggcaccagcaucacccagaaggggaucaucuucauccugcucaugcuggugacccccuccauggccaugcggugcgucggcaucggcaaccgcgacuucguggaggggcugagcggcgccacguggguggacgucgugcucgagcacggguccugcgugaccaccauggccaagaacaagcccacccuggacaucgagcugcucaagacggaggucaccaaccccgcggugcugcggaagcugugcaucgaggccaagaucagcaacaccaccacggacucccgcugcccgacccagggcgaggccacccucguggaggagcaggacgccaacuucgucugccggcgcaccuucguggaccggggcugggggaacggcugcgggcuguucggcaaggggagccugcucacgugcgccaaguucaagugcgugaccaagcuggagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcucaccgacuacggggcccugacccuggacugcagcccccggaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcucgagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcugaagcucuccugguucaagcgcgggagcuccaucggcaagauguucgaggccaccgcccgcggggcccgccgcauggccauccugggcgacacggcgugggacuucgggagcaucggcggcguguucaccuccguggggaagcugguccaccagaucuucggcaccgccuacgggguccuguucagcggcguguccuggaccaugaagaucgggaucggcauccugcugacguggcucggccugaacagccgguccaccagccuguccaugaccugcaucgccgucgggauggugacccucuaccugggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcucagcgcggccaucggcaaggccugggaggagggggugugcggcauccgcuccgccacccggcuggagaacaucauguggaagcagaucagcaacgagcugaaccacauccuccuggagaacgacaugaaguucaccguggucgugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcgucuucaccacgaacaucuggcucaagcugcgcgacuccuacacccagaugugcgaccaccggcugaugagcgcggccaucaaggacuccaaggccgugcacgccgacaugggcuacuggaucgagagcgagaagaacgagaccuggaagcucgcccgcgcguccuucaucgaggugaagaccugcacguggcccaagagccacacccugugguccaacgggguccuggagagcgagaugaucauccccaagaucuacggcgggccgaucucccagcacaacuaccggcccggcuacuucacccagaccgccgggcccuggcaccucggcaagcuggagcuggacuucgaccucugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacagcuucucccugggcauccucugcgucagcaucaugaucgaggaggugaugcggucccgcuggagccgcaagaugcugaugaccgggacgcuggccguguuccuccugcugaucaugggccagcucaccuggaacgaccugauccggcugugcaucauggucggggccaacgcguccgaccgcaugggcaugggcaccaccuaccucgcccugauggccacguucaagaugcggccgauguucgccguggggcuccucuuccgccggcugaccagccgcgaggugcugcuccugaccaucggccugucccucgucgccagcguggagcugcccaacucccuggaggagcucggggacggccuggcgaugggcaucaugaugcugaagcuccugaccgaguuccagccccaccagcuguggacgacccuccugagccugaccuucgucaagaccacgcucucccuggacuacgccuggaagaccaccgccauggcccugagcaucgugucccucuucccccugugccugagcaccacgucccagaagaccaccuggcucccggugcugcuggggagcuucggcugcaagccccucaccauguuccugaucaccgagaacaagaucugggggcggaaguccuggccccugaacgagggcaucauggcgaucgggaucgucagcauccuccuguccagccugcucaagaacgacgugccccuggccggcccgcugaucgccggcgggaugcucaucgccugcuacgugaucagcggcuccagcgccgaccugucccuggagaaggcggccgaggucagcugggagcaggaggccgagcacuccggggccagccacuccauccucguggaggugcaggacgacggcacgaugaagaucaaggacgaggagcgcgacgacacccugaccauccugcucaaggccacccugcuggcggucagcgggguguaccccauguccauccccgccacccucuucgugugguacuucuggcagaagaagaagcagcggagcggcguccugugggacacccccuccccgcccgagguggagcgcgccgugcuggacaacggcaucuaccggauccuccagcgcgggcugcugggccggagccaggucggggugggcguguuccaggacggggucuuccacaccauguggcacgugacccgcggcgccgugcugauguaccagggcaagcggcucgagcccuccugggccagcgucaagaaggaccugaucuccuacgggggcggguggcgcuuccagggcagcuggaacacgggggaggagguccaggugaucgcggucgagcccggcaagaacccgaagaacgugcagaccacccccggcaccuucaagacgcccgagggggaggugggcgccaucgcccuggacuucaagcccgggaccuccggcagcccgaucgucaaccgggagggcaagaucguggggcucuacggcaacgggguggucaccaccuccggcacguacgugagcgccaucgcccaggcgaaggccagccaggaggggccccugcccgagaucgaggacgagguguucaagaagcgcaaccugaccaucauggaccuccacccgggcuccggcaagacccggcgcuaccugcccgccaucguccgggaggccaucaagcgcaagcugcgcacccucauccuggcgcccacgcgggugguggccagcgagauggccgaggcccugaaggggaugcccauccgcuaccagaccaccgccgucaaguccgagcacaccggccgggagaucguggaccucaugugccacgcgacguucaccaugcgccugcugagcccggugcggguccccaacuacaacaugaucaucauggacgaggcccacuucaccgaccccgccuccaucgccgcccgcggguacaucagcacccgggugggcaugggggaggcggccgccaucuucaugacggccacgccgcccggcuccguggaggccuucccccagagcaacgcggucauccaggacgaggagcgcgacauccccgagcgguccuggaacagcggcuacgacuggaucaccgacuuccccgggaagaccgugugguucgugcccuccaucaagagcggcaacgacaucgccaacugccuccgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccugaagcccgugauccucaaggacgggcccgagcgggugauccuggcgggcccgaugcccgucaccgccgccuccgccgcccagcgccggggccgcaucgggcgcaaccagaacaaggagggcgaccaguacguguacauggggcagccccugaacaacgacgaggaccacgcgcacuggaccgaggccaagaugcuccuggacaacaucaacacccccgagggcaucaucccggcccuguucgagcccgagcgggagaaguccgccgccaucgacggggaguaccgccuccggggcgaggcgcgcaagacguucgucgagcugaugcggcgcggcgaccugcccguguggcucuccuacaagguggccagcgagggguuccaguacuccgaccggcgcuggugcuucgacggcgagcggaacaaccagguccuggaggagaacauggacguggagaucuggaccaaggagggggagcgcaagaagcugcggccccgcuggcucgacgcccggaccuacagcgacccgcuggcccugcgcgaguucaaggaguucgccgcgggccggcgcagcguguccggcgaccucauccuggagaucgggaagcugccccagcaccucacccugcgggcccagaacgcccuggacaaccucgucaugcugcacaacagcgagcagggcgggaaggccuaccgccacgcgauggaggagcugcccgacaccaucgagacgcucaugcugcuggcccucaucgccgugcugaccggcggggugacccuguucuuccucuccggcaagggccuggggaagaccagcaucggccugcucugcgucacggccuccagcgcccugcuguggauggcguccguggagccccacuggaucgccgccagcaucauccucgaguucuuccugauggugcugcucaucccggagcccgaccggcagcgcacgccccaggacaaccagcuggccuacgucgugaucgggcuccucuucaugauccugaccguggccgcgaacgagaugggccugcucgagaccacgaagaaggaccuggggaucggcuacgucgccgccgagaaccaccagcacgccaccaugcuggacguggaccuccacccggccuccgcguggacccuguacgccguggccaccacggucaucacccccaugaugcggcacaccaucgagaacaccacggccaacaucagccugaccgccaucgcgaaccaggccgccauccucaugggccuggacaagggguggcccaucuccaagauggacaucggcgugccccugcucgcccuggggugcuacagccaggugaacccgcugacccucaccgcggccguccugaugcugguggcccacuacgccaucaucggccccgggcuccaggccaaggcgacgcgcgaggcccagaagcgcaccgccgccggcaucaugaagaaccccaccguggacggcaucgucgccaucgaccuggaccccgugguguacgacgcgaaguucgagaagcagcuggggcagaucaugcuccugauccugugcaccucccagauccuccugaugcggacgaccugggcccugugcgagagcaucacccucgccaccggcccgcugacgacccugugggaggggucccccggcaaguucuggaacaccaccaucgccgucagcauggccaacaucuuccgcggcuccuaccucgcgggggccggccuggccuucagccugaugaagucccucgggggcgggcggcgcggcacgggcgcccagggggagacccugggcgagaaguggaagcggcagcugaaccagcucagcaagagcgaguucaacaccuacaagcgcuccgggaucauggagguggaccggagcgaggcgaaggagggccugaagcgcggggagaccacgaagcacgccgugucccggggcaccgccaagcugcgcugguucgucgagcggaaccucgugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccuggugaagcuccacuccggcaaggacgucuucuucaugccgcccgagaagugcgacacgcugcugugcgacaucggggagagcuccccgaaccccaccaucgaggagggccggacccuccgcgugcugaagaugguggagcccuggcugcggggcaaccaguucugcaucaagauccucaaccccuacaugccgagcgucguggagacccuggagcgcaugcagcggaagcacgggggcaugcuggugcgcaacccccucucccggaacagcacgcacgagauguacugggucuccugcgggaccggcaacaucgugagcgcggugaacaugaccucccgcaugcugcugaaccgcuucaccauggcccaccggaagcccacguacgagcgcgacgucgaccucggcgccgggacccggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcugcucacgaagcccugggacgucauccccauggugacccagaucgccaugaccgacaccacgccguucggccagcagcgcguguucaaggagaaggucgacacccggacgccccgcgccaagcggggcaccacgcagaucauggaggugaccgccaaguggcuguggggguuccugagccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccucguccaccgcgagcgggagcugcacaagcaggggaagugcgccacgugcguguacaacaugaugggcaagcgcgagaagaagcugggggaguucggcaaggccaagggcagccgggccaucugguacauguggcucggggcccgcuuccuggaguucgaggcgcugggcuucaugaacgaggaccacugguucucccgggagaacagccucuccgggguggagggcgaggggcugcacaagcugggcuacauccuccgcgacaucagcaagaucccgggcgggaacauguacgccgacgacaccgccggcugggacacccgcgucaccgaggacgaccugcagaacgaggccaagaucacggacaucauggagcccgagcacgcccugcucgcgaccuccaucuucaagcugaccuaccagaacaagguggugcggguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuuccugcccuccgagcuggagaccccgaaccucgccgagcgggcccuggacuggcuggagaagcacggcgccgagcgccucaagcggauggcgaucagcggggacgacugcguggucaagcccaucgacgaccgcuucgccacggcccugaccgcccugaacgacaugggcaaggugcggaaggacaucccccagugggagcccuccaagggcuggaacgacuggcagcaggucccguucugcagccaccacuuccaccagcucaucaugaaggacgggcgcgagaucgucgugcccugccggaaccaggacgagcuggugggccgcgcccgggucucccagggggcgggcuggagccugcgcgagaccgccugccucgggaaguccuacgcccagauguggcagcugauguacuuccaccggcgcgaccugcggcucgccgcgaacgccaucugcagcgccgugcccguggacuggguccccaccagccgcaccacgugguccauccacgcccaccaccaguggaugaccaccgaggacaugcugagcguguggaaccgcguguggaucgaggagaacccguggauggaggacaagacccacgucuccagcugggaggaggugcccuaccugggcaagcgggaggaccaguggugcggcucccucaucgggcugacggcccgcgcgaccugggccaccaacauccagguggccaucaaccagguccggcgccugaucggcaacgagaacuaccucgacuacaugaccagcaugaagcgguucaagaacgaguccgacagcgagggggcccugugguga

SEQ ID NO: 8189 - RNA, 9879 nt, Artificial Sequence
  derived and/or modified CDS sequence (opt1) from DENV-1__KJ189362__SS-prME
agcgugaccaugcugcucaugcugcugcccaccgcccucgccuuccaccugaccacccggggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgggagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcacccugguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaaggggaugacccagaacggccggcucaucacggccaacccgaucgugaccgacaaggagaagcccgucaacaucgagaccgagccgcccuucggggagagcuacaucguggugggcgccggcgagaaggcgcugaagcuguccugguucaagcgcgggagcuccaucggcaagauguucgaggccaccgcccgcggggcccgccgcauggccauccucggcgacacggcgugggacuucgggagcaucggcggcgucuucaccuccguggggaagcuggugcaccagaucuucggcaccgccuacgggguccuguucagcggcguguccuggaccaugaagaucgggaucggcauccuccugacguggcugggccucaacagccgguccaccagccuguccaugaccugcaucgccguggggauggucacccuguaccucggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcucgagaacaucauguggaagcagaucagcaacgagcugaaccacauccugcucgagaacgacaugaaguucaccgugguggucggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccucugguccaacggggugcuggagagcgagaugaucauccccaagaucuacggcgggccgaucucccagcacaacuaccggcccggcuacuucacccagaccgccgggcccuggcaccugggcaagcucgagcuggacuucgaccugugcgagggcacgaccgucgugguggacgagcacugcgggaaccgcggcccgagccuccggaccaccacggucaccgggaagaucauccacgaguggugcugccgcuccugcacccugccgccccugcgguuccgcggcgaggacgggugcugguacggcauggagauccggcccgugaaggagaaggaggagaaccucgugcgcagcauggucuccgccggcagcggggagguggacagcuucucccugggcauccugugcgugagcaucaugaucgaggaggucaugcggucccgcuggagccgcaagaugcucaugaccgggacgcuggccguguuccugcuccugaucaugggccagcugaccuggaacgaccucauccggcugugcaucauggugggggccaacgcguccgaccgcaugggcaugggcaccaccuaccuggcccucauggccacguucaagaugcggccgauguucgccgucgggcugcuguuccgccggcucaccagccgcgaggugcugcugcucaccaucggccugucccugguggccagcgucgagcuccccaacucccuggaggagcugggggacggccucgcgaugggcaucaugaugcugaagcugcucaccgaguuccagccccaccagcuguggacgacccugcucagccugaccuucgugcggaccacgcugucccucgacuacgccuggaagaccaccgccauggcccugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggcgaucgggaucgugagcauccugcucuccagccugcugaagaacgacgucccccucgccggcccgcugaucgccggcgggaugcugaucgccugcuacgugaucagcggcuccagcgccgaccucucccuggagaaggcggccgaggugagcugggagcaggaggccgagcacuccggggccagccacuccauccuggucgaggugcaggacgacggcacgaugaagaucaaggacgaggagcgggacgacacccucaccauccugcugaaggccacccuccuggcggugagcggggucuaccccauguccauccccgccacgcuguucgugugguacuucuggcagaagaagaagcagcgcagcggcgugcucugggacacccccuccccgcccgaggucgagcgggccgugcuggacaacggcaucuaccgcauccugcagcgggggcugcucggccgcagccaggugggggucggcguguuccaggacgggguguuccacaccauguggcacgucacccggggcgccgugcugauguaccagggcaagcgccuggagcccuccugggccagcgugaagaaggaccucaucuccuacgggggcggguggcgguuccagggcagcuggaacacgggggaggagguccaggugaucgcgguggagcccggcaagaacccgaagaacguccagaccacccccggcaccuucaagacgcccgagggggaggugggcgccaucgcccuggacuucaagcccgggaccuccggcagcccgaucgugaaccgcgagggcaagaucgucgggcuguacggcaacgggguggugaccaccuccggcacguacgucagcgccaucgcccaggcgaaggccagccaggaggggccccuccccgagaucgaggacgagguguucaagaagcggaaccugaccaucauggaccugcacccgggcuccggcaagacccgccgguaccuccccgccaucgugcgcgaggccaucaagcgcaagcugcggacccugauccucgcgcccacgcgcgucguggccagcgagauggccgaggcccugaaggggaugcccauccgguaccagaccaccgccgugaaguccgagcacaccggccgcgagaucgucgaccugaugugccacgcgacguucaccaugcggcuccugagcccggugcgcgugcccaacuacaacaugaucaucauggacgaggcccacuucaccgaccccgccuccaucgccgcccggggguacaucagcacccgcgucggcaugggggaggcggccgccaucuucaugacggccacgccgcccggcuccguggaggccuucccccagagcaacgcggugauccaggacgaggagcgggacauccccgagcgcuccuggaacagcggcuacgacuggaucaccgacuuccccgggaagaccgucugguucgugcccuccaucaagagcggcaacgacaucgccaacugccugcggaagaacgggaagcgcgugauccagcucucccggaagacguucgacaccgaguaccagaagaccaagaacaacgacugggacuacgucgugaccacggacaucagcgagaugggcgccaacuuccgcgccgaccgggugaucgacccccgccggugccugaagcccgucauccugaaggacgggcccgagcgcgugauccucgcgggcccgaugcccgugaccgccgccuccgccgcccagcggcgcggccgcaucgggcggaaccagaacaaggagggcgaccaguacgucuacauggggcagccccugaacaacgacgaggaccacgcgcacuggaccgaggccaagaugcugcucgacaacaucaacacccccgagggcaucaucccggcccuguucgagcccgagcgcgagaaguccgccgccaucgacggggaguaccggcugcgcggcgaggcgcggaagacguucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccgcucgcccugcgggaguucaaggaguucgccgcgggccgccggagcguguccggcgaccugauccucgagaucgggaagcugccccagcaccugacccuccgcgcccagaacgcccuggacaaccuggugaugcuccacaacagcgagcagggcgggaaggccuaccggcacgcgauggaggagcugcccgacaccaucgagacgcugaugcuccuggcccugaucgccguccucaccggcggggugacccuguucuuccuguccggcaagggccucgggaagaccagcaucggccugcugugcgugacggccuccagcguccuccuguggauggccuccguggagccccacuggaucgcggccagcaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgcggccgagaaccaccagcacgccaccaugcuggacguggaccugcacccggccuccgccuggacccucuacgcgguggccaccacggucaucacccccaugaugcgccacaccaucgagaacaccacggccaacaucagccugaccgccaucgccaaccaggcggccauccugaugggccucgacaagggguggcccaucuccaagauggacaucggcgugccccugcuggcccucgggugcuacagccaggugaacccgcugacccugaccgccgcgguccucaugcugguggcccacuacgccaucaucggccccgggcugcaggccaaggccacgcgcgaggcgcagaagcggaccgccgccggcaucaugaagaaccccaccguggacggcaucgucgccaucgaccucgaccccgugguguacgacgccaaguucgagaagcagcuggggcagaucaugcugcucauccugugcaccucccagauccugcucaugcgcacgaccugggcgcugugcgagagcaucacccuggccaccggcccgcucacgacccugugggaggggucccccggcaaguucuggaacaccaccaucgccgucagcauggccaacaucuuccggggcuccuaccuggccggggcgggccucgccuucagccugaugaagucccucgggggcgggcgccgggggacgggcgcccagggggagacccucggcgagaaguggaagcgccagcugaaccagcugagcaagagcgaguucaacaccuacaagcgguccgggaucauggagguggaccgcagcgaggccaaggagggccucaagcgcggggagaccacgaagcacgcggugucccgcggcaccgccaagcugcggugguucgucgagcgcaaccuggugaagcccgagggcaaggugaucgaccuggggugcggccgcgggggcuggagcuacuacugcgccgggcucaagaaggucaccgaggugaagggcuacaccaagggcgggcccggccacgaggagccgauccccauggccaccuacggguggaaccuggugaagcugcacuccggcaaggacgucuucuucaugccgcccgagaagugcgacacgcuccugugcgacaucggggagagcuccccgaaccccaccaucgaggagggccgcacccugcgggugcucaagaugguggagcccuggcugcgcggcaaccaguucugcaucaagauccugaaccccuacaugccgagcgucguggagacccucgagcggaugcagcgcaagcacgggggcaugcuggugcggaacccccugucccgcaacagcacgcacgagauguacugggucuccugcgggaccggcaacaucgugagcgccgugaacaugaccucccgcaugcuccugaaccgguucaccauggcgcaccgcaagcccacguacgagcgggacgucgaccugggcgccgggacccgccacguggccguggagcccgaggucgccaaccucgacaucaucggccagcggaucgagaacaucaagaacgagcacaagagcaccuggcacuacgacgaggacaacccguacaagaccugggccuaccacggguccuacgaggugaagcccagcggcuccgcgagcuccauggugaacggggucgugcgccugcugacgaagcccugggacgucauccccauggugacccagaucgccaugaccgacaccacgccguucggccagcagcggguguucaaggagaaggucgacacccgcacgccccgggccaagcgcggcaccacgcagaucauggaggugaccgccaaguggcucuggggguuccugagccggaacaagaagccccgcaucugcacccgggaggaguucacccgcaaggugcggagcaacgccgcgaucggcgccgucuucguggacgagaaccaguggaacuccgccaaggaggccguggaggacgagcgcuucugggaccugguccaccgggagcgcgagcuccacaagcaggggaagugcgcgacgugcguguacaacaugaugggcaagcgggagaagaagcugggggaguucggcaaggccaagggcagccgcgccaucugguacauguggcugggggcccgguuccucgaguucgaggcccugggcuucaugaacgaggaccacugguucucccgcgagaacagccuguccgggguggagggcgaggggcuccacaagcugggcuacauccugcgcgacaucagcaagaucccgggcgggaacauguacgcggacgacaccgccggcugggacacccgggucaccgaggacgaccuccagaacgaggccaagaucacggacaucauggagcccgagcacgcccugcuggccaccuccaucuucaagcucaccuaccagaacaagguggugcgcguccagcggcccgcgaagaacgggaccgugauggacgugaucagccgccgggaccagcgcggcuccggccaggucgggacguacggccugaacaccuucaccaacauggaggugcagcugauccggcagauggagagcgaggggaucuuccuccccuccgagcuggagaccccgaaccuggccgagcgcgcccucgacuggcuggagaagcacggcgccgagcggcugaagcgcauggccaucagcggggacgacugcguggucaagcccaucgacgaccgguucgcgacggcccucaccgcccugaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcucgugggccgggcccgcgucucccagggggccggcuggagccugcgggagaccgcgugccuggggaaguccuacgcccagauguggcagcucauguacuuccaccgccgggaccugcgccuggccgccaacgcgaucugcagcgccgugcccguggacuggguccccaccagccgcaccacgugguccauccacgcccaccaccaguggaugaccaccgaggacaugcucagcguguggaaccggguguggaucgaggagaacccguggauggagaacaagacccacgucuccagcugggaggaggugcccuaccugggcaagcgcgaggaccaguggugcggcucccugaucgggcucacggcccgggccaccugggcgaccaacauccagguggccaucaaccagguccgccggcugaucggcaacgagaacuaccuggacuacaugaccagcaugaagcgcuucaagaacgaguccgacagcgagggggcccucugguga

SEQ ID NO: 8190 - RNA, 9879 nt, Artificial Sequence
  derived and/or modified CDS sequence (opt1) from DENV-1__KJ189363__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacacgugggucaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccacccgggguucauggugaucgccuucuuccuggcgcacgccaucggcacgagcaucacccagaaggggaucaucuucauccuccugaugcuggugacccccuccauggccaugcggugcgucggcaucggcaaccgcgacuucguggaggggcucagcggcgccaccuggguggacgucgugcuggagcacggguccugcgugacgaccauggccaagaacaagcccacccuggacaucgagcuccugaagaccgaggucacgaaccccgcggugcugcggaagcucugcaucgaggccaagaucagcaacaccaccaccgacucccgcugcccgacgcagggcgaggccacccugguggaggagcaggacgccaacuucgucugccggcgcaccuucguggaccggggcugggggaacggcugcgggcuguucggcaaggggagccuccugaccugcgccaaguucaagugcgugacgaagcuggagggcaagaucguccaguacgagaaccucaaguacuccgugaucgugaccguccacaccggcgaccagcaccagguggggaacgagaccacggagcacggcaccaucgcgaccaucaccccccaggcccccaccagcgagauccagcugacggacuacggggcccugacccucgacugcuccccccgcaccggccuggacuucaacgagaugguccugcucaccaugaaggagaagagcuggcuggugcacaagcagugguuccuggaccucccgcugcccuggacguccggggccagcaccagccaggagaccuggaaccggcaggaccugcucgugaccuucaagacggcccacgcgaagaagcaggaggucguggugcugggcucccaggagggcgccaugcacaccgcccugaccggggccaccgagauccagacgagcggcaccaccaccaucuucgccgggcaccucaagugccgccugaagauggacaagcugacgcucaagggcauguccuacgucaugugcaccgggagcuucaagcuggagaaggagguggcggagacccagcacggcaccgugcugguccaggugaaguacgagggcacggacgcccccugcaagauccccuucuccacccaggacgagaagggggugacccagaacggccggcugaucaccgccaacccgaucgucacggacaaggagaagcccgugaacaucgagaccgagccccccuucggggagagcuacaucguggucggcgccggcgagaaggcgcucaagcuguccugguucaagcgcgggagcuccaucggcaagauguucgaggccaccgcccggggggcccgccgcauggccauccugggcgacaccgcgugggacuucgggagcaucggcggcguguucacguccguggggaagcucguccaccagaucuucggcaccgccuacggggugcuguucagcggcguguccuggaccaugaagaucgggaucggcauccugcucaccuggcugggccugaacagccgguccacgagccucuccaugaccugcaucgccgucgggauggugacccuguaccugggcgugaugguccaggccgacagcgggugcgugaucaacuggaagggccgcgagcucaagugcggguccggcaucuucgugaccaacgagguccacacguggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccguggucgugggggacgccaacggcauccucgcgcaggggaagaagaugauccgcccccagcccauggagcacaaguacuccuggaagagcuggggcaaggccaagaucaucggcgccgacauccagaacaccacguucaucaucgacgggcccgacaccccggagugccccgacggccagcgggccuggaacaucugggagguggaggacuacggguucggcgucuucaccaccaacaucuggcugaagcugcgcgacuccuacacgcagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcaccuggcccaagagccacacgcugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcaccacggugguggucgacgagcacugcgggaaccgcggcccgagccugcggaccaccaccgugacggggaagaucauccacgaguggugcugccgcuccugcacccuccccccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacccucgccguguuccugcugcucaucaugggccagcugacguggaacgaccugauccggcucugcaucauggucggggccaacgcguccgaccgcaugggcaugggcaccaccuaccuggcccugauggccaccuucaagaugcggccgauguucgccguggggcuccuguuccgccggcugacgagccgcgaggugcuccugcugaccaucggccucucccuggucgccagcguggagcugcccaacucccucgaggagcugggggacggccuggcgaugggcaucaugaugcucaagcugcugaccgaguuccagccccaccagcucuggaccacgcugcugagccucaccuucgucaagaccacccugucccuggacuacgccuggaagacgaccgccauggcccucagcaucgugucccuguucccccugugccucagcaccaccucccagaagacgaccuggcugccggugcugcucgggagcuucggcugcaagccccugaccauguuccugaucaccgagaacaagaucugggggcggaaguccuggccccucaacgagggcaucauggcgaucgggaucgucagcauccugcuguccagccuccugaagaacgacgugccccuggccggcccgcucaucgccggcgggaugcugaucgccugcuacgugaucagcggcuccagcgccgaccugucccucgagaaggcggccgaggucagcugggagcaggaggccgagcacuccggggccagccacuccauccugguggaggugcaggacgacggcaccaugaagaucaaggacgaggagcgcgacgacacgcugaccauccuccugaaggccacccugcucgcggucagcgggguguaccccauguccauccccgccacccuguucgugugguacuucuggcagaagaagaagcagcggagcggcguccugugggacacgcccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacaccggggaggaggugcaggugaucgcggucgagcccggcaagaacccgaagaacgugcagacgacccccggcaccuucaagacccccgagggggaggugggcgccaucgcccucgacuucaagcccgggacguccggcagcccgaucgucaaccgggagggcaagaucguggggcuguacggcaacgggguggucaccaccuccggcaccuacgugagcgccaucgcccaggcgaaggccagccaggaggggccccugcccgagaucgaggacgagguguucaagaagcgcaaccucacgaucauggaccugcacccgggcuccggcaagacccggcgcuaccugcccgccaucguccgggaggccaucaagcgcaagcuccgcacccugauccuggcgcccacccgggugguggccagcgagauggccgaggcccucaaggggaugcccauccgcuaccagacgaccgccgucaaguccgagcacaccggccgggagaucguggaccugaugugccacgcgaccuucacgaugcgccugcucagcccggugcggguccccaacuacaacaugaucaucauggacgaggcccacuucaccgaccccgccuccaucgccgcccgcggguacaucagcacccgggugggcaugggggaggcggccgccaucuucaugaccgccacgcccccgggcuccguggaggccuucccccagagcaacgcggucauccaggacgaggagcgcgacauccccgagcgguccuggaacagcggcuacgacuggaucaccgacuuccccgggaagaccgugugguucgugccguccaucaagagcggcaacgacaucgccaacugccugcgcaagaacgggaagcgggucauccagcugucccgcaagaccuucgacacggaguaccagaagaccaagaacaacgacugggacuacguggugaccaccgacaucagcgagaugggcgccaacuuccgggccgaccgcgucaucgacccccggcgcugccucaagcccgugauccugaaggacgggcccgagcgggugauccuggcgggcccgaugcccgucacggccgccuccgccgcccagcgccggggccgcaucgggcgcaaccagaacaaggagggcgaccaguacguguacauggggcagccccucaacaacgacgaggaccacgcgcacuggaccgaggccaagaugcugcuggacaacaucaacacccccgagggcaucaucccggcccucuucgagcccgagcgggagaagagcgccgccaucgacggggaguaccgccugcggggcgaggcgcgcaagaccuucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggacgaaggagggggagcgcaagaagcuccggccccgcuggcuggacgcccggaccuacagcgacccgcuggcccuccgcgaguucaaggaguucgccgcgggccggcgcagcguguccggcgaccugauccuggagaucgggaagcucccccagcaccugacccugcgggcccagaacgcccucgacaaccuggucaugcugcacaacagcgagcagggcgggaaggccuaccgccacgcgauggaggagcuccccgacaccaucgagacccugaugcugcucgcccugaucgccgugcugacgggcggggugacccucuucuuccuguccggcaagggccuggggaagaccagcaucggccuccugugcgucaccgccuccagcgcccugcucuggauggcguccguggagccccacuggaucgccgccagcaucauccuggaguucuuccugauggugcuccugaucccggagcccgaccggcagcgcacgccccaggacaaccagcuggccuacgucgugaucgggcuccuguucaugauccugaccguggccgcgaacgagaugggccuccuggagaccaccaagaaggaccuggggaucggcuacgucgccgccgagaaccaccagcacgccacgaugcucgacguggaccugcacccggccuccgcguggacccuguacgccguggccaccaccgucaucacgcccaugaugcggcacaccaucgagaacaccaccgccaacaucagccucacggccaucgcgaaccaggccgccauccugaugggccuggacaagggguggcccaucuccaagauggacaucggcgugccccuccuggcccuggggugcuacagccaggugaacccgcucacccugaccgcggccguccugaugcucguggcccacuacgccaucaucggccccgggcugcaggccaaggcgacccgcgaggcccagaagcgcacggccgccggcaucaugaagaaccccaccguggacggcaucgucgccaucgaccuggaccccgugguguacgacgcgaaguucgagaagcagcucgggcagaucaugcugcugauccucugcaccucccagauccugcugaugcggaccacgugggcccucugcgagagcaucacccuggccaccggcccgcugaccacgcucugggaggggucccccggcaaguucuggaacaccaccaucgccgucagcauggccaacaucuuccgcggcuccuaccuggcgggggccggccuggccuucagccucaugaagucccuggggggcgggcggcgcggcaccggcgcccagggggagacgcugggcgagaaguggaagcggcagcucaaccagcugagcaagagcgaguucaacaccuacaagcgcuccgggaucauggagguggaccggagcgaggcgaaggagggccugaagcgcggggagaccaccaagcacgccgugucccggggcacggccaagcuccgcugguucgucgagcggaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccccccgagaagugcgacacccugcucugcgacaucggggagagcuccccgaaccccacgaucgaggagggccggacccugcgcgugcugaagaugguggagcccuggcuccggggcaaccaguucugcaucaagauccugaaccccuacaugccgagcgucguggagacccuggagcgcaugcagcggaagcacgggggcaugcucgugcgcaacccccugucccggaacagcacccacgagauguacugggucuccugcgggacgggcaacaucgugagcgcggugaacaugaccucccgcaugcugcucaaccgcuucaccauggcccaccggaagcccaccuacgagcgcgacgucgaccugggcgccgggacgcggcacguggccguggagcccgaggucgccaaccuggacaucaucggccagcgcaucgagaacaucaagaacgagcacaagagcaccuggcacuacgacgaggacaacccguacaagaccugggcguaccacggguccuacgaggugaagcccagcggcuccgccagcuccauggugaacggggucgugcggcuccugaccaagcccugggacgucauccccauggugacgcagaucgccaugaccgacaccaccccguucggccagcagcgcguguucaaggagaaggucgacacgcggaccccccgcgccaagcggggcaccacccagaucauggaggugacggccaaguggcuguggggguuccucagccgcaacaagaagccccggaucugcacccgcgaggaguucacccggaaggugcgcagcaacgcggccaucggcgccgucuucguggacgagaaccaguggaacuccgccaaggaggcgguggaggacgagcgguucugggaccugguccaccgcgagcgggagcugcacaagcaggggaagugcgccaccugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagaucccgggcgggaacauguacgccgacgacacggccggcugggacacccgcgucaccgaggacgaccugcagaacgaggccaagaucaccgacaucauggagcccgagcacgcccuccuggcgacguccaucuucaagcugaccuaccagaacaagguggugcggguccagcgccccgccaagaacgggaccgugauggacgugaucagccggcgcgaccagcggggcuccggccaggucgggaccuacggccucaacacguucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggcgaucagcggggacgacugcguggucaagcccaucgacgaccgcuucgccaccgcccugacggcccucaacgacaugggcaaggugcggaaggacaucccccagugggagcccuccaagggcuggaacgacuggcagcaggugccguucugcagccaccacuuccaccagcugaucaugaaggacgggcgcgagaucgucgugcccugccggaaccaggacgagcuggugggccgcgcccgggucucccagggggcgggcuggagccuccgcgagaccgccugccuggggaaguccuacgcccagauguggcagcugauguacuuccaccggcgcgaccuccggcuggccgcgaacgccaucugcagcgccgugcccguggacuggguccccaccagccgcaccaccugguccauccacgcccaccaccaguggaugacgaccgaggacaugcugagcguguggaaccgcguguggaucgaggagaacccguggauggagaacaagacccacgucuccagcugggaggaggugcccuaccucggcaagcgggaggaccaguggugcggcucccugaucgggcugaccgcccgcgcgacgugggccaccaacauccagguggccaucaaccagguccggcgccucaucggcaacgagaacuaccuggacuacaugaccagcaugaagcgguucaagaacgaguccgacagcgagggggcccugugguga

SEQ ID NO: 8191 - RNA, 9879 nt, Artificial Sequence
  derived and/or modified CDS sequence (opt1) from DENV-1__KJ189364__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgggagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaaggggaugacccagaacggccggcugaucacggccaacccgaucgugaccgacaaggagaagcccgucaacaucgagaccgagccgcccuucggggagagcuacaucguggugggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcgucuucaccuccguggggaagcucgugcaccagaucuucggcaccgccuacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgcggccaucaaggacuccaaggccguccacgccgacaugggcuacuggaucgagagcgagaagaacgagaccuggaagcuggcccgcgcguccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccgucgggcuccuguuccgccggcugaccagccgcgaggugcuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugcggaccacgcugucccuggacuacgccuggaagaccaccgccauggcccucagcaucgucucccuguucccccugugccucagcaccacgucccagaagaccaccuggcugccggugcugcucgggagcuucggcugcaagccccugaccauguuccugaucaccgagaacaagaucugggggcgcaaguccuggccccucaacgagggcaucauggcgaucgggaucgugagcauccugcuguccagccuccugaagaacgacgucccccuggccggcccgcucaucgccggcgggaugcugaucgccugcuacgugaucagcggcuccagcgccgaccugucccucgagaaggcggccgaggugagcugggagcaggaggccgagcacuccggggccagccacuccauccuggucgaggugcaggacgacggcacgaugaagaucaaggacgaggagcgggacgacacccugaccauccuccugaaggccacccugcucgcggugagcggggucuaccccauguccauccccgccacgcuguucgugugguacuucuggcagaagaagaagcagcgcagcggcgugcugugggacacccccuccccgcccgaggucgagcgggccgugcucgacaacggcaucuaccgcauccugcagcgggggcugcugggccgcagccaggugggggucggcguguuccaggacgggguguuccacaccauguggcacgucacccggggcgccgugcucauguaccagggcaagcgccuggagcccuccugggccagcgugaagaaggaccugaucuccuacgggggcggguggcgguuccagggcagcuggaacacgggggaggagguccaggugaucgcgguggagcccggcaagaacccgaagaacguccagaccacccccggcaccuucaagacgcccgagggggaggugggcgccaucgcccucgacuucaagcccgggaccuccggcagcccgaucgugaaccgcgagggcaagaucgucgggcuguacggcaacgggguggugaccaccuccggcacguacgucagcgccaucgcccaggcgaaggccagccaggaggggccccugcccgagaucgaggacgagguguucaagaagcggaaccucaccaucauggaccugcacccgggcuccggcaagacccgccgguaccugcccgccaucgugcgcgaggccaucaagcgcaagcuccggacccugauccuggcgcccacgcgcgucguggccagcgagauggccgaggcccucaaggggaugcccauccgguaccagaccaccgccgugaaguccgagcacaccggccgcgagaucgucgaccugaugugccacgcgacguucaccaugcggcugcucagcccggugcgcgugcccaacuacaacaugaucaucauggacgaggcccacuucaccgaccccgccuccaucgccgcccggggguacaucagcacccgcgucggcaugggggaggcggccgccaucuucaugacggccacgccgcccggcuccguggaggccuucccccagagcaacgcggugauccaggacgaggagcgggacauccccgagcgcuccuggaacagcggcuacgacuggaucaccgacuuccccgggaagaccgucugguucgugcccuccaucaagagcggcaacgacaucgccaacugccugcggaagaacgggaagcgcgugauccagcugucccggaagacguucgacaccgaguaccagaagaccaagaacaacgacugggacuacgucgugaccacggacaucagcgagaugggcgccaacuuccgcgccgaccgggugaucgacccccgccggugccucaagcccgucauccugaaggacgggcccgagcgcgugauccuggcgggcccgaugcccgugaccgccgccuccgccgcccagcggcgcggccgcaucgggcggaaccagaacaaggagggcgaccaguacgucuacauggggcagccccucaacaacgacgaggaccacgcgcacuggaccgaggccaagaugcugcuggacaacaucaacacccccgagggcaucaucccggcccucuucgagcccgagcgcgagaaguccgccgccaucgacggggaguaccggcugcgcggcgaggcgcggaagacguucguggagcugaugcgccggggcgaccuccccgucuggcuguccuacaagguggccagcgagggguuccaguacuccgaccgccgguggugcuucgacggcgagcgcaacaaccaggugcuggaggagaacauggacgucgagaucuggaccaaggagggggagcggaagaagcuccgcccccgguggcuggacgcccgcaccuacagcgacccgcuggcccuccgggaguucaaggaguucgccgcgggccgccggagcguguccggcgaccugauccuggagaucgggaagcucccccagcaccugacccugcgcgcccagaacgcccucgacaaccuggugaugcugcacaacagcgagcagggcgggaaggccuaccggcacgcgauggaggagcuccccgacaccaucgagacgcugaugcugcucgcccugaucgccguccugaccggcggggugacccucuucuuccuguccggcaagggccuggggaagaccagcaucggccuccugugcgugacggccuccagcgcccugcucuggauggcguccgucgagccccacuggaucgccgccagcaucauccuggaguucuuccugauggugcuccugaucccggagcccgaccgccagcggacgccccaggacaaccagcuggccuacguggucaucgggcuccuguucaugauccugaccguggccgcgaacgagaugggccuccuggagaccacgaagaaggaccuggggaucggcuacguggccgccgagaaccaccagcacgccaccaugcucgacgucgaccugcacccggccuccgcguggacccuguacgccguggccaccacggugaucacccccaugaugcgccacaccaucgagaacaccacggccaacaucagccucaccgccaucgcgaaccaggccgccauccugaugggccuggacaagggguggcccaucuccaagauggacaucggcgucccccuccuggcccuggggugcuacagccaggugaacccgcucacccugaccgcggccgugcugaugcucgucgcccacuacgccaucaucggccccgggcugcaggccaaggcgacgcgcgaggcccagaagcggaccgccgccggcaucaugaagaaccccaccguggacggcaucguggccaucgaccuggaccccgucguguacgacgcgaaguucgagaagcagcucgggcagaucaugcugcugauccucugcaccucccagauccugcugaugcgcacgaccugggcccucugcgagagcaucacccuggccaccggcccgcugacgacccucugggaggggucccccggcaaguucuggaacaccaccaucgccgugagcauggccaacaucuuccggggcuccuaccuggcgggggccggccuggccuucagccucaugaagucccucgggggcgggcgccggggcacgggcgcccagggggagacccugggcgagaaguggaagcgccagcucaaccagcugagcaagagcgaguucaacaccuacaagcgguccgggaucauggaggucgaccgcagcgaggcgaaggagggccugaagcgcggggagaccacgaagcacgccgugucccgcggcaccgccaagcuccggugguucguggagcgcaaccuggucaagcccgagggcaaggugaucgaccuggggugcggccgcgggggcuggagcuacuacugcgccgggcugaagaaggugaccgaggucaagggcuacaccaagggcgggcccggccacgaggagccgauccccauggccaccuacggguggaaccucgugaagcugcacuccggcaaggacguguucuucaugccgcccgagaagugcgacacgcugcucugcgacaucggggagagcuccccgaaccccaccaucgaggagggccgcacccugcggguccugaagaugguggagcccuggcuccgcggcaaccaguucugcaucaagauccugaaccccuacaugccgagcguggucgagacccuggagcggaugcagcgcaagcacgggggcaugcucgugcggaacccccugucccgcaacagcacgcacgagauguacuggguguccugcgggaccggcaacaucgucagcgcggugaacaugaccucccgcaugcugcucaaccgguucaccauggcccaccgcaagcccacguacgagcgggacguggaccugggcgccgggacccgccacgucgccguggagcccgagguggccaaccuggacaucaucggccagcggaucgagaacaucaagaacgagcacaagagcaccuggcacuacgacgaggacaacccguacaagaccugggcguaccacggguccuacgaggucaagcccagcggcuccgccagcuccauggugaacggggugguccgccuccugacgaagcccugggacgugauccccauggucacccagaucgccaugaccgacaccacgccguucggccagcagcggguguucaaggagaagguggacacccgcacgccccgggccaagcgcggcaccacgcagaucauggaggucaccgccaaguggcuguggagcuuccucagccggaacaagaagccccgcaucugcacccgggaggaguucacccgcaaggugcgguccaacgcggccaucggggccguguucgucgacgagaaccaguggaacagcgccaaggaggcgguggaggacgagcgcuucugggaccuggugcaccgggagcgcgagcugcacaagcagggcaagugcgccacgugcgucuacaacaugauggggaagcgggagaagaagcucggcgaguucgggaaggccaagggcucccgcgccaucugguacauguggcugggcgcccgguuccuggaguucgaggcgcucggguucaugaacgaggaccacugguucagccgcgagaacucccugagcggcguggagggggagggccugcacaagcucggguacauccugcgcgacaucuccaagaucccgggcggcaacauguacgccgacgacaccgccgggugggacacccgggugaccgaggacgaccugcagaacgaggccaagaucacggacaucauggagcccgagcacgcccuccuggcgaccagcaucuucaagcugaccuaccagaacaaggucgugcgcgugcagcggcccgccaagaacggcaccgucauggacgugaucucccgccgggaccagcgcgggagcggccaggugggcacguacgggcucaacaccuucaccaacauggagguccagcugauccggcagauggaguccgagggcaucuuccugcccagcgagcucgagaccccgaaccuggccgagcgcgcccuggacuggcucgagaagcacggggccgagcggcugaagcgcauggcgaucuccggcgacgacugcguggugaagcccaucgacgaccgguucgccacggcccugaccgcccucaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcugguggggcgggcccgcgugagccagggcgcgggguggucccuccgggagaccgccugccugggcaagagcuacgcccagauguggcagcugauguacuuccaccgccgggaccuccgccuggccgcgaacgccaucugcagcgccguccccguggacugggugcccaccucccgcaccacguggagcauccacgcccaccaccaguggaugaccaccgaggacaugcuguccgucuggaaccggguguggaucgaggagaacccguggauggagaacaagacccacgugagcuccugggaggagguccccuaccucgggaagcgcgaggaccaguggugcggcagccugaucggccugacggcccgggcgaccugggccaccaacauccagguggccaucaaccaggugcgccggcucaucgggaacgagaacuaccuggacuacaugaccuccaugaagcgcuucaagaacgagagcgacuccgagggcgcccugugguga

SEQ ID NO: 8192 - RNA, 9879 nt, Artificial Sequence
  derived and/or modified CDS sequence (opt1) from DENV-1__KJ189365__SS-prME
agcgugaccaugcugcucaugcugcugcccaccgcccucgccuuccaccugaccacccgcggcggggagccccacaugaucgucagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagaucuucggcaccgccuacggggugcuguucagcggcguguccuggaccaugaagaucgggaucggcauccugcucacguggcugggccugaacagccgguccaccagccucuccaugaccugcaucgucguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgccgcgaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgccgcgaucaaggacuccaaggccgugcacgccgacaugggcuacuggaucgagagcgagaagaacgagaccuggaagcuggcccgcgccuccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggccaugggcaucaugaugcucaagcugcugaccgaguuccagccccaccagcucuggacgacccugcugagccucaccuucgugaagaccacgcugucccuggacuacgcguggaagaccaccgccauggcccucagcaucgugucccuguucccccugugccucagcaccacgucccagaagaccaccuggcugccgguccugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgugccccuggcgggcccgcucaucgccggcgggaugcugaucgccugcuacgucaucagcggcuccagcgccgaccugucccucgagaaggccgcggaggugagcugggagcaggaggccgagcacuccggggccagccacuccauccugguggagguccaggacgacggcacgaugaagaucaaggacgaggagcgcgacgacacccugaccauccuccugaaggccacccugcucgccgugagcgggguguaccccauguccauccccgcgacgcuguucgucugguacuucuggcagaagaagaagcagcggagcggcgugcugugggacacccccuccccgcccgagguggagcgcgccguccucgacaacggcaucuaccggauccugcagcgcgggcugcugggccggagccaggugggggugggcgucuuccaggacgggguguuccacaccauguggcacgugacccgcggcgccguccucauguaccagggcaagcggcuggagcccuccugggccagcgugaagaaggaccugaucuccuacgggggcggguggcgcuuccagggcagcuggaacacgggggaggaggugcaggucaucgccguggagcccggcaagaacccgaagaacgugcagaccacccccggcaccuucaagacgcccgagggggaggucggcgcgaucgcccucgacuucaagcccgggaccuccggcagcccgaucgugaaccgggagggcaagaucguggggcuguacggcaacggggucgugaccaccuccggcacguacgugagcgccaucgcccaggccaaggcgagccaggaggggccccugcccgagaucgaggacgaggucuucaagaagcgcaaccucaccaucauggaccugcacccgggcuccggcaagacccggcgcuaccugcccgccaucgugcgggaggccaucaagcgcaagcuccgcacccugauccuggcccccacgcggguggucgcgagcgagauggccgaggcccucaaggggaugcccauccgcuaccagaccaccgccgugaaguccgagcacaccggccgggagaucguggaccugaugugccacgccacguucaccaugcgccugcucagcccgguccgggugcccaacuacaacaugaucaucauggacgaggcgcacuucaccgaccccgccuccaucgccgcccgcggguacaucagcacccgggugggcaugggggaggccgcggccaucuucaugacggccacgccgcccggcuccgucgaggccuucccccagagcaacgccgugauccaggacgaggagcgcgacauccccgagcgguccuggaacagcggcuacgacuggaucaccgacuuccccgggaagaccgugugguucguccccuccaucaagagcggcaacgacaucgcgaacugccugcgcaagaacgggaagcgggugauccagcugucccgcaagacguucgacaccgaguaccagaagaccaagaacaacgacugggacuacguggucaccacggacaucagcgagaugggcgccaacuuccgggccgaccgcgugaucgacccccggcgcugccucaagcccgugauccugaaggacgggcccgagcgggucauccuggccggcccgaugcccgugaccgcggccuccgccgcccagcgccggggccgcaucgggcgcaaccagaacaaggagggcgaccaguacgucuacauggggcagccccucaacaacgacgaggaccacgcccacuggaccgaggcgaagaugcugcuggacaacaucaacacccccgagggcaucaucccggcccucuucgagcccgagcgggagaaguccgccgccaucgacggggaguaccgccugcggggcgaggcccgcaagacguucguggagcugaugcggcgcggcgaccuccccguguggcuguccuacaaggucgcgagcgagggguuccaguacuccgaccggcgcuggugcuucgacggcgagcggaacaaccaggugcuggaggagaacauggacguggagaucuggaccaaggagggggagcgcaagaagcuccggccccgcuggcuggacgcccggaccuacagcgacccgcuggcccuccgcgaguucaaggaguucgccgccggccggcgcagcgucuccggcgaccugauccuggagaucgggaagcucccccagcaccugacccugcgggcgcagaacgcccucgacaaccuggugaugcugcacaacagcgagcagggcgggaaggccuaccgccacgccauggaggagcuccccgacaccaucgagacgcugaugcugcucgcgcugaucgccgugcugaccggcggggucacccucuucuuccuguccggcaagggccuggggaagaccagcaucggccuccugugcgugacggccuccagcgcccugcucuggauggccuccguggagccccacuggaucgcggccagcaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagaccacgaagaaggaccuggggaucggcuacguggcggccgagaaccaccagcacgccaccaugcucgacguggaccugcacccggccuccgccuggacccuguacgcggucgccaccacggugaucacccccaugaugcggcacaccaucgagaacaccacggccaacaucagccucaccgccaucgccaaccaggcggccauccugaugggccuggacaagggguggcccaucuccaagauggacaucggcgugccccuccuggcccuggggugcuacagccaggucaacccgcucacccugaccgccgcggugcugaugcucguggcccacuacgccaucaucggccccgggcugcaggccaaggccacgcgcgaggcgcagaagcgcaccgccgccggcaucaugaagaaccccaccgucgacggcaucguggccaucgaccuggaccccguggucuacgacgccaaguucgagaagcagcucgggcagaucaugcugcugauccucugcaccucccagauccugcugaugcggacgaccugggcgcucugcgagagcaucacccuggccaccggcccgcugacgacccucugggaggggucccccggcaaguucuggaacaccaccaucgccgugagcauggccaacaucuuccgcggcuccuaccuggccggggcgggccuggccuucagccucaugaagucccucgggggcgggcggcgcggcacgggcgcccagggggagacccugggcgagaaguggaagcggcagcucaaccagcugagcaagagcgaguucaacaccuacaagcgcuccgggaucauggagguggaccggagcgaggccaaggagggccugaagcgcggggagaccacgaagcacgcggucucccggggcaccgccaagcuccgcugguucguggagcggaaccuggugaagcccgagggcaaggucaucgaccuggggugcggccgcgggggcuggagcuacuacugcgccgggcugaagaaggugaccgaggugaagggcuacaccaagggcgggcccggccacgaggagccgauccccauggccaccuacggguggaaccucgucaagcugcacuccggcaaggacguguucuucaugccgcccgagaagugcgacacgcugcucugcgacaucggggagagcuccccgaaccccaccaucgaggagggccggacccugcgcgugcugaagauggucgagcccuggcuccggggcaaccaguucugcaucaagauccugaaccccuacaugccgagcgugguggagacccuggagcgcaugcagcggaagcacgggggcaugcucguccgcaacccccugucccggaacagcacgcacgagauguacuggguguccugcgggaccggcaacaucgugagcgccgucaacaugaccucccgcaugcugcucaaccgcuucaccauggcgcaccggaagcccacguacgagcgcgacguggaccugggcgccgggacccggcacguggccgucgagcccgagguggccaaccuggacaucaucggccagcgcaucgagaacaucaagaacgagcacaagagcaccuggcacuacgacgaggacaacccguacaagaccugggccuaccacggguccuacgaggugaagcccagcggcuccgcgagcuccauggucaacggggugguccggcuccugacgaagcccugggacgugauccccauggugacccagaucgccaugaccgacaccacgccguucggccagcagcgcgucuucaaggagaagguggacacccggacgccccgcgccaagcggggcaccacgcagaucauggaggugaccgccaaguggcuguggggguuccucagccgcaacaagaagccccggaucugcacccgcgaggaguucacccggaagguccgcagcaacgccgcgaucggcgccguguucguggacgagaaccaguggaacuccgccaaggaggccgucgaggacgagcgguucugggaccuggugcaccgcgagcgggagcugcacaagcaggggaagugcgcgacgugcguguacaacaugaugggcaagcgcgagaagaagcucggggaguucggcaaggccaagggcagccgggccaucugguacauguggcugggggcccgcuuccuggaguucgaggcccucggcuucaugaacgaggaccacugguucucccgggagaacagccuguccggggucgagggcgaggggcugcacaagcucggcuacauccugcgcgacaucagcaagaucccgggcgggaacauguacgcggacgacaccgccggcugggacacccgcgugaccgaggacgaccugcagaacgaggccaagaucacggacaucauggagcccgagcacgcccuccuggccaccuccaucuucaagcugaccuaccagaacaaggugguccgggugcagcgccccgcgaagaacgggaccgugauggacgucaucagccggcgcgaccagcggggcuccggccagguggggacguacggccucaacaccuucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggccaucagcggggacgacugcgucgugaagcccaucgacgaccgcuucgcgacggcccugaccgcccucaacgacaugggcaaggugcggaaggacaucccccagugggagcccuccaagggcuggaacgacuggcagcaggucccguucugcagccaccacuuccaccagcugaucaugaaggacgggcgcgagaucguggugcccugccggaaccaggacgagcuggucggccgcgcccgggugucccagggggccggcuggagccuccgcgagaccgcgugccuggggaaguccuacgcccagauguggcagcugauguacuuccaccggcgcgaccuccggcuggccgccaacgcgaucugcagcgccgugcccgucgacugggugcccaccagccgcaccacgugguccauccacgcccaccaccaguggaugaccaccgaggacaugcugagcguguggaaccgcgucuggaucgacgagaacccguggauggagaacaagacccacguguccagcugggaggaggugcccuaccucggcaagcgggaggaccaguggugcggcucccugaucgggcugacggcccgcgccaccugggcgaccaacauccaggucgccaucaaccaggugcggcgccucaucggcaacgagaacuaccuggacuacaugaccagcaugaagcgguucaagaacgaguccgacagcgagggggcccugugguga

SEQ ID NO: 8193 - RNA, 9879 nt, Artificial Sequence
  derived and/or modified CDS sequence (opt1) from DENV-1__KJ189366__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccgcaucgccgaggccgagcccgacgacguggacugcuggugcaacgccaccgacaccugggugacguacgggaccugcagccagaccggcgagcaccggcgcgagaagcgguccguggcgcuggcgccccacgugggccuggggcucgagacccgcacggagaccuggaugagcuccgagggcgccuggaagcagauccagcgggucgagaccugggcccugcgccaccccggguucaccgugaucgccuucuuccuggcccacgccaucggcacgagcaucacccagaaggggaucaucuucauccuccugaugcuggugacccccuccauggccaugcggugcgucggcaucggcaaccgcgacuucguggaggggcucagcggcgccaccuggguggacgucgugcuggagcacggguccugcgugacgaccauggcgaagaacaagcccacccuggacaucgagcuccugaagaccgaggucacgaaccccgccgugcugcggaagcucugcaucgaggccaagaucagcaacaccaccaccgacucccgcugccccacgcagggcgaggccacccugguggaggagcaggacgccaacuucgucugccggcgcaccuucguggaccggggcugggggaacggcugcgggcuguucggcaaggggagccuccugaccugcgcgaaguucaagugcgugacgaagcuggagggcaagaucguccaguacgagaaccucaaguacuccgugaucgugaccguccacaccggcgaccagcaccagguggggaacgagaccacggagcacggcaccaucgccaccaucacgccccaggcccccaccagcgagauccagcugacggacuacggggcccugacccucgacugcagcccccggaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcgcacgccaagaagcaggaggucguggugcugggcucccaggagggcgccaugcacaccgcccugaccggggccaccgagauccagacgagcggcaccaccaccaucuucgcggggcaccucaagugccgccugaagauggacaagcugacgcucaagggcauguccuacgucaugugcaccgggagcuucaagcuggagaaggagguggccgagacccagcacggcaccgugcugguccaggugaaguacgagggcacggacgcccccugcaagauccccuucuccacccaggacgagaagggggugacccagaacggccggcugaucaccgccaacccgaucgucacggacaaggagaagcccgugaacaucgagaccgagccgcccuucggggagagcuacaucguggucggcgcgggcgagaaggcccucaagcuguccugguucaagcgcgggagcuccaucggcaagauguucgaggccaccgcccgcggggcccgccgcauggcgauccugggcgacaccgccugggacuucgggagcaucggcggcguguucacguccguggggaagcucguccaccagaucuucggcaccgccuacggggugcuguucagcggcguguccuggaccaugaagaucgggaucggcauccugcucaccuggcugggccugaacagccgguccacgagccucuccaugaccugcaucgccgucgggauggugacccuguaccugggcgugaugguccaggccgacagcgggugcgugaucaacuggaagggccgcgagcucaagugcggguccggcaucuucgugaccaacgagguccacacguggaccgagcaguacaaguuccaggcggacagcccgaagcggcugagcgccgccaucggcaaggccugggaggagggggugugcggcauccgcuccgccacccggcuggagaacaucauguggaagcagaucagcaacgagcucaaccacauccugcuggagaacgacaugaaguucaccguggucgugggggacgcgaacggcauccucgcccaggggaagaagaugauccgcccccagcccauggagcacaaguacuccuggaaguccuggggcaaggccaagaucaucggcgccgacauccagaacaccacguucaucaucgacgggcccgacaccccggagugccccgacggccagcgggcguggaacaucugggagguggaggacuacggguucggcgucuucaccaccaacaucuggcugaagcugcgcgacuccuacacgcagaugugcgaccaccggcucaugagcgccgccaucaaggacuccaaggccgugcacgccgacaugggcuacuggaucgagagcgagaagaacgagaccuggaagcuggcgcgcgccuccuucaucgaggugaagaccugcaccuggcccaagagccacacgcugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcaccacggugguggucgacgagcacugcgggaaccgcggcccgagccugcggaccaccaccgugacggggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacagcuucucccucggcauccugugcgucagcaucaugaucgaggaggugaugcggucccgcuggagccgcaagaugcugaugaccgggacccucgccguguuccugcugcucaucaugggccagcugacguggaacgaccugauccggcucugcaucauggucggggcgaacgccuccgaccgcaugggcaugggcaccaccuaccuggcccugauggccaccuucaagaugcggccgauguucgccguggggcuccuguuccgccggcugacgagccgcgaggugcuccugcugaccaucggccucucccuggucgcgagcguggagcugcccaacucccucgaggagcugggggacggccuggccaugggcaucaugaugcucaagcugcugaccgaguuccagccccaccagcucuggaccacgcugcugagccucaccuucgucaagaccacccugucccuggacuacgccuggaagacgaccgccauggcgcucagcaucgugucccuguucccccugugccucagcaccaccucccagaagacgaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccuggccggcccgcucaucgccggcgggaugcugaucgccugcuacgugaucagcggcuccagcgcggaccugucccucgagaaggccgccgaggucagcugggagcaggaggccgagcacuccggggccagccacuccauccugguggaggugcaggacgacggcaccaugaagaucaaggacgaggagcgcgacgacacgcugaccauccuccugaaggcgacccugcucgccgucagcgggguguaccccauguccauccccgccacccuguucgugugguacuucuggcagaagaagaagcagcggagcggcguccugugggacacgcccuccccgcccgagguggagcgcgccgugcucgacaacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggcgagcgucaagaaggaccugaucuccuacgggggcggguggcgcuuccagggcagcuggaacaccggggaggagguccaggugaucgccgucgagcccggcaagaacccgaagaacgugcagacgacccccggcaccuucaagacccccgagggggaggugggcgccaucgcccucgacuucaagcccgggacguccggcagcccgaucgucaaccgggagggcaagaucguggggcuguacggcaacgggguggucaccaccuccggcaccuacgugagcgccaucgcgcaggccaaggccagccaggaggggccccugcccgagaucgaggacgagguguucaagaagcgcaaccucacgaucauggaccugcacccgggcuccggcaagacccggcgcuaccugcccgccaucguccgggaggcgaucaagcgcaagcuccgcacccugauccuggcccccacccgggugguggccagcgagauggccgaggcccucaaggggaugcccauccgcuaccagacgaccgcggucaaguccgagcacaccggccgggagaucguggaccugaugugccacgccaccuucacgaugcgccugcucagcccggugcggguccccaacuacaacaugaucaucauggacgaggcccacuucaccgaccccgccuccaucgccgcgcgcggguacaucagcacccgggugggcaugggggaggccgccgccaucuucaugaccgccacgcccccgggcuccguggaggcguucccccagagcaacgccgucauccaggacgaggagcgcgacauccccgagcgguccuggaacagcggcuacgacuggaucaccgacuuccccgggaagaccgugugguucgugccguccaucaagagcggcaacgacaucgccaacugccugcgcaagaacgggaagcgggucauccagcugucccgcaagaccuucgacacggaguaccagaagaccaagaacagcgacugggacuacguggugaccaccgacaucuccgagaugggcgccaacuuccgggcggaccgcgucaucgacccccggcgcugccucaagcccgugauccugaaggacgggcccgagcgggugauccuggccggcccgaugcccgucacggccgccagcgccgcgcagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgcgaucgacggggaguaccgccugcggggcgaggcccgcaagaccuucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggacgaaggagggggagcgcaagaagcuccggccccgcuggcuggacgcccggaccuacagcgacccgcuggcccuccgcgaguucaaggaguucgcggccggccggcgcuccgugagcggcgaccugauccuggagaucgggaagcucccccagcaccugacccugcgggcccagaacgcccucgacaaccuggucaugcugcacaacuccgagcagggcgggaaggcguaccgccacgccauggaggagcuccccgacaccaucgagacccugaugcugcucgcccugaucgccgugcugacgggcggggugacccucuucuuccugagcggcaagggccuggggaagaccuccaucggccuccugugcgucaccgccagcuccgcgcugcucuggauggccagcguggagccccacuggaucgccgccuccaucauccuggaguucuuccugauggugcuccugaucccggagcccgaccggcagcgcacgccccaggacaaccagcuggccuacgucgugaucgggcuccuguucaugauccugaccguggcggccaacgagaugggccuccuggagaccaccaagaaggaccuggggaucggcuacgucgccgccgagaaccaccagcacgugacgaugcucgacguggaccugcacccggccagcgcguggacccuguacgccgucgccaccaccgugaucacgcccaugaugcggcacaccaucgagaacgccaccgccaacaucucccucaccgcgaucgccaaccaggccgccauccugaugggccuggacaagggguggcccaucagcaagauggacaucggcgugccccuccuggcgcuggggugcuacucccaggucaacccgcucacgcugaccgccgccgugcugaugcucguggcccacuacgccaucaucggccccgggcugcaggcgaaggccacccgcgaggcccagaagcgcaccgccgccggcaucaugaagaaccccacggucgacggcaucguggcgaucgaccuggaccccguggucuacgacgccaaguucgagaagcagcucgggcagaucaugcugcugauccucugcaccagccagauccugcugaugcggaccaccugggcccucugcgaguccaucacgcuggccaccggcccgcugaccacccucugggaggggagccccggcaaguucuggaacacgaccaucgccguguccauggcgaacaucuuccgcggcagcuaccuggccggggccggccuggccuucucccucaugaagucccucgggggcgggcggcgcgggaccggcgcgcagggggagacccugggcgagaaguggaagcggcagcucaaccagcugagcaaguccgaguucaacacguacaagcgcagcgggaucauggagguggaccgguccgaggccaaggagggccugaagcgcggggagaccaccaagcacgccgucagccggggcaccgccaagcuccgcugguucguggagcggaaccuggugaagcccgagggcaaggucaucgaccuggggugcggccgcgggggcugguccuacuacugcgccgggcugaagaaggugacggaggugaagggcuacaccaagggcgggcccggccacgaggagccgauccccauggcgaccuacggguggaaccucgucaagcugcacagcggcaaggacguguucuucaugccgcccgagaagugcgacacccugcucugcgacaucggggaguccagcccgaaccccaccguggaggagggccggacgcugcgcguccugaagaugguggagcccuggcuccggggcaaccaguucugcaucaagauccugaaccccuacaugccguccguggucgagacccuggagcgcaugcagcggaagcacgggggcaugcucgugcgcaacccccugagccggaacuccacccacgagauguacugggugagcugcgggaccggcaacaucgucuccgccgugaacaugacgagccgcaugcugcucaaccgcuucaccauggcccaccggaagcccaccuacgagcgcgacguggaccugggcgccgggacccggcacgucgccguggagcccgagguggcgaaccuggacaucaucggccagcgcaucgagaacaucaagaacgagcacaaguccacguggcacuacgacgaggacaacccguacaagaccugggccuaccacgggagcuacgaggucaagcccuccggcagcgccuccagcauggugaacggggucgugcggcuccugaccaagcccugggacgugauccccauggucacccagaucgccaugacggacaccaccccguucggccagcagcgcguguucaaggagaagguggacacccggacgccccgcgccaagcggggcaccacccagaucauggaggucaccgcgaaguggcuguggggguuccucagccgcaacaagaagccccggaucugcacgcgcgaggaguucacccggaaggugcgcuccaacgccgccgugggcgccgucuucguggacgagaaccaguggaacagcgcgaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaagggcucccgggccaucugguacauguggcugggggcgcgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgccgacgacaccgccggcugggacacgcgcgucaccgaggacgaccugcagaacgaggccaagaucaccgacaucauggagcccgagcacgcgcuccuggccaccagcaucuucaagcugacguaccagaacaagguggugcggguccagcgccccgccaagaacgggaccgugauggacgugaucucccggcgcgaccagcggggcagcggccaggucgggaccuacggccucaacaccuucacgaacauggaggugcagcugauccgccagauggaguccgaggggaucuuccugcccagcgagcucgagaccccgaaccuggccgagcgggcccuggacuggcucgagaagcacggcgcggagcgccugaagcggauggccaucuccggggacgacugcguggucaagcccaucgacgaccgcuucgccaccgcccugaccgcccucaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcuggugggccgcgcgcgggucagccagggggccggcuggucccuccgcgagacggccugccugggcaagagcuacgcccagauguggcagcugauguacuuccaccggcgcgaccuccggcuggcggccaacgccaucugcagcgccgugcccguggacuggguccccaccucccgcaccaccuggagcauccacgcccaccaccaguggaugaccacggaggacaugcuguccguguggaaccgcguguggaucgaggagaacccguggauggagaacaagacccacgucagcuccugggaggaggugcccuaccucggcaagcgggaggaccaguggugcggcagccugaucgggcugaccgcgcgcgccaccugggccacgaacauccagguggccaucaaccagguccggcgccucaucggcaacgagaacuaccuggacuacaugaccuccaugaagcgguucaagaacgagagcgacuccgagggggcccugugguga

SEQ ID NO: 8194 - RNA, 9879 nt, Artificial Sequence
  derived and/or modified CDS sequence (opt1) from DENV-1__JN819417__SS-prME
agcgugaccaugcugcucaugcugcugcccaccgcccucgccuuccaccugaccacccggggcggggagccccacauggucgugagcaagcaggagcggggcaagagccugcuguucaagaccagcgccggggugaacaugugcacccugaucgccauggaccugggcgagcucugcgaggacaccaugaccuacaagugcccccggaucaccgaggccgagcccgacgacgucgacugcuggugcaacgccaccgacaccugggugaccuacgggaccugcagccagaccggcgagcaccggcgggacaagcgguccguggcccuggcgccccacgucggccuggggcucgagacccggaccgagaccuggaugagcuccgagggcgccuggaagcagauccagaagguggagaccugggcccugcggcaccccggguucacggugaucgcccuguuccucgcgcacgccaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgcgauccuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccagcacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccacgagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccuccggcauccuggcgcaggggaagaagaugauccgcccccagcccauggagcacaaguacagcuggaaguccuggggcaaggccaagaucaucggcgccgacacgcagaacaccaccuucaucaucgacgggcccgacaccccggagugccccgacgaccagcgggccuggaacaucugggaggucgaggacuacggcuucgggaucuucacgaccaacaucuggcugaagcuccgcgacagcuacacccagaugugcgaccaccggcugauguccgcggccaucaaggacagcaaggccgugcacgccgacaugggcuacuggaucgaguccgagaagaacgagaccuggaagcuggcccgcgcgagcuucaucgaggugaagacgugcaucuggcccaagucccacacccucuggagcaacggcguccuggaguccgagaugaucauccccaagaucuacgggggcccgaucagccagcacaacuaccggcccggguacuucacccagaccgccggccccuggcaccuggggaagcucgagcuggacuucgaccugugcgagggcacgaccgugguggucgacgagcacugcggcaaccgcgggccgucccuccggaccaccacggugaccggcaagaucauccacgaguggugcugccgcagcugcacccugccgccccugcgguuccgcggggaggacggcugcugguacgggauggagauccggcccgugaaggagaaggaggagaaccucguccgcuccauggugagcgccggcagcggcgagguggacuccuucagccuggggauccugugcgucuccaucaugaucgaggaggugaugcggagccgcuggucccggaagaugcucaugaccggcacgcuggccguguuccugcuccugaucauggggcagcugaccuggaacgaccucauccgccugugcaucauggucggcgccaacgcgagcgaccgcauggggaugggcaccaccuaccuggcccucaugggcacguucaagaugcggccgauguucgccguggggcugcuguuccgccggcucaccucccgcgaggugcugcugcucaccaucggccugagccuggucgccuccguggagcuccccaacagccuggaggagcugggggacggccucgccaugggcaucaugaugcugaagcugcucaccgaguuccagccccaccagcuguggacgacccugcucucccugaccuucaucaagaccacgcugagccucgacuacgcguggaagaccauggccaugguccuguccaucgugagccuguucccccucugccuguccaccaccagccagaagacgaccuggcugccggugcuccugggguccuucggcugcaagccccugaccauguuccucaucaccgagaacaagaucugggggcgcaagagcuggccccugaacgagggcaucauggccaucgggaucgucuccauccugcucagcagccugcugaagaacgacgugccccucgccggcccgcugaucgcgggcgggaugcugaucgccugcuacgugaucuccggcagcuccgccgaccucagccuggagaaggccgccgagaucuccugggaggaggaggcggagcacagcgggaccucccacaacauccuggucgaggugcaggacgacggcacgaugaagaucaaggacgaggagcgcgacgacacccucaccauccugcugaaggccacccuccuggccgugagcggggucuaccccauguccauccccgccacgcuguucgugugguacuucuggcagaagaagaagcagcggagcggcgugcucugggacacccccuccccgcccgaggucgagcgcgccgugcuggacgacggcaucuaccggauccugcagcgcgggcugcucggccggagccaggugggggucggcguguuccaggacgggguguuccacaccauguggcacgucacccgcggcgcggugcugauguaccagggcaagcggcuggagcccuccugggccagcgugaagaaggaccucaucuccuacgggggcggguggcgcuuccagggcagcuggaacacgggggaggagguccaggugaucgccguggagcccggcaagaacccgaagaacguccagaccacccccggcaccuucaagacgcccgagggggaggugggcgccaucgcccuggacuucaagcccgggaccuccggcagcccgaucgugaaccgggagggcaagaucgucgggcuguacggcaacgggguggugaccaccuccggcacguacgucagcgcgaucgcccaggccaaggccagccaggaggggccccuccccgagaucgaggacgagguguucaagaagcgcaaccugaccaucauggaccugcacccgggcuccggcaagacccggcgcuaccuccccgccaucgugcgggaggcgaucaagcgcaagcugcggacccugauccucgcccccacgcgcgucguggccagcgagauggccgaggcgcugaaggggaugcccauccgcuaccagaccaccgccgugaaguccgagcacaccggccgggagaucgucgaccugaugugccacgccacguucaccaugcgccuccugagcccggugcgggugcccaacuacaacaugaucaucauggacgaggcccacuucaccgaccccgccuccaucgcggcccgcggguacaucagcacccgggucggcaugggggaggccgccgccaucuucaugacggcgacgccgcccggcuccguggaggccuucccccagagcaacgccgugauccaggacgaggagcgcgacauccccgagcgguccuggaacagcggcuacgacuggaucaccgacuuccccgggaagaccaucugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccccggcgcugccugaagcccgugauccugaaggacgggcccgagcgggucauccucgccggcccgaugcccgugaccguggccuccgccgcgcagcgccggggccgcaucgggcggaaccagaacaaggagggcgaccaguacgucuacauggggcagccccugaacaacgacgaggaccacgcccacuggaccgaggccaagaugcugcucgacaacaucaacacccccgagggcaucaucccggcccuguucgagcccgagcgcgagaaguccgccgcgaucgacggggaguaccgccugcggggcgaggcccgcaagacguucguggagcucaugcggcgcggcgaccugcccgucuggcuguccuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcccggaccuacagcgacccgcucgcccugcgcgaguucaaggaguucgcggccggccggcgcagcaucuccggcgaccugauccucgagaucgggaagcugccccagcaccugacccuccgggcccagaacgcccuggacaaccuggugaugcuccacaacagcgagcagggcgggaaggccuaccgccacgcgauggaggagcugcccgacaccaucgagacgcugaugcuccuggcccugaucgccgugcucaccggcggggucacccuguucuuccuguccggcaagggccucgggaagaccagcaucggccugcugugcgugauggccuccagcgcgcuccuguggauggccaacguggagccccacuggaucgccgccuccaucauccuggaguucuuccucaugguccugcugaucccggagcccgaccggcagcgcacgccccaggacaaccagcucgccuacguggugaucgggcugcuguucaugauccucaccgucgcggccaacgagaugggccugcuggagaccaccaagaaggaccucgggaucggccacguggccgccgagaaccaccaccacgccacgaugcuggacguggaccugcggccggcgagcgccuggacccucuacgccgucgccaccaccgugaucacgcccaugaugcgccacaccaucgagaacaccaccgccaacaucucccugacggcgaucgccaaccaggccgccauccugaugggccucgacaagggguggcccaucagcaagauggacaucggcgugccccugcuggcccucgggugcuacucccaggucaacccgcugacccugaccgcggccgugcucaugcugguggcccacuacgccaucaucggccccgggcugcaggcgaaggccacccgggaggcccagaagcgcacggccgccggcaucaugaagaaccccaccgucgacggcaucguggcgaucgaccucgaccccguggucuacgacgccaaguucgagaagcagcuggggcagaucaugcugcucauccugugcaccagccagauccugcucaugcgcaccacgugggcccugugcgaguccaucacccuggccaccggcccgcucaccacgcugugggaggggagccccggcaaguucuggaacaccaccaucgccguguccauggcgaacaucuuccggggcagcuaccuggccggggccggccucgccuucucccugaugaagucccucgggggcgggcgccgggggaccggcgcccagggggagacgcucggcgagaaguggaagcgccagcugaaccagcuguccaagagcgaguucaacaccuacaagcggagcgggaucauggagguggaccgcuccgaggcgaaggagggccucaagcgcggggagaccaccaagcacgccgucagccgcggcacggccaagcugcggugguucguggagcgcaaccuggugaagcccgagggcaaggucaucgaccuggggugcggccgcggcgggugguccuacuacugcgccgggcucaagaaggugaccgaggugaagggguacaccaagggcgggcccggccacgaggagccgauccccauggcgaccuacggguggaaccuggucaagcugcacagcggcaaggacguguucuucacgccgcccgagaagugcgacacgcuccugugcgacaucggggaguccagcccgaaccccaccaucgaggagggccgcacccugcgggugcucaagauggucgagcccuggcugcgcggcaaccaguucugcaucaagauccugaaccccuacaugccguccgugguggagacccucgagcagaugcagcggaagcacgggggcaugcugguccgcaacccccugagccggaacuccacgcacgagauguacugggugagcugcgggaccggcaacaucguguccgccgucaacaugaccagccgcaugcuccugaaccgguucaccauggcccaccgcaagcccacguacgagaaggacguggaccugggcgccgggacccgccacguggccgucgagcccgagguggcgaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccugcugacgaagcccugggacgucauccccauggugacccagaucgccaugaccgacaccacgccguucggccagcagcgggucuucaaggagaagguggacacccgcacgccccgggccaagcgcggcaccgcgcagaucauggaggugacggccaaguggcucuggggguuccugucccggaacaagaagccccgcaucugcacccgggaggaguucaccaagaagguccgcagcaacgccgccaucggcgccguguucguggacgagaaccaguggaacagcgcgaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggccaagggcucccgggcgaucugguacauguggcugggggcccgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgccgacgacacggccggcugggacacccggaucaccgaggacgaccuccagaacgaggcgaagaucaccgacaucauggagcccgagcacgcccugcuggccacgagcaucuucaagcucaccuaccagaacaagguggugcgcguccagcggcccgccaagaacgggaacgugauggacgugaucucccgccgcgaccagcggggcagcggccaggucgggaccuacggccugaacaccuucacgaacauggaggugcagcugauccgccagauggaguccgaggggaucuuccuccccagcgagcuggagaccccgaaccuggccgagcgggugcucgacuggcuggagaagcacggcgcggagcgccugaagcggauggccaucuccggggacgacugcgucgugaagcccaucgacgaccgcuucgccaccgcccucaucgcccugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcgcgggugagccagggggccggcuggucccugcgcgagaccgccugccugggcaagagcuacgcccagauguggcagcucauguacuuccaccggcgcgaccugcggcuggccgcgaacgccaucugcuccgccgugcccgucgacugggugcccacgagccgcaccaccuggagcauccacgcccaccaccaguggaugaccaccgaggacaugcucuccguguggaaccgggucuggaucgaggagaacccguggauggaggacaagacgcacgugagcuccugggaggaggugcccuaccugggcaagcgcgaggaccaguggugcggcagccugaucgggcucaccgcgcgggccaccugggccaccaacauccaggucgccaucaaccaggugcgccgccugaucggcaacgagaacuaccuggacuacaugacguccaugaagcgguucaagaacgagagcgaccccgagggggcccucugguga

SEQ ID NO: 8195 - RNA, 9879 nt, Artificial Sequence
  derived and/or modified CDS sequence (opt1) from DENV-1__FJ687426__SS-prME
agcgugaccaugcugcucaugcugaugcccaccgcccuggccuuccaccucaccacccggggcggggagccccacaugaucgucagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgggcgccuccuucaucgaggucaagaccugcaucuggcccaagagccacacccucugguccaacggggugcuggagagcgagaugaucauccccaagaucuacggcgggccgaucucccagcacaacuaccggcccggcuacuucacgcagaccgccgggcccuggcaccugggcaagcucgagcuggacuucgaccugugcgagggcaccaccguggucguggacgagcacugcgggaaccgcggcccgagccuccggacgaccaccgugaccgggaagaucauccacgaguggugcugccgcuccugcacgcugccgccccugcgguuccgcggcgaggacgggugcugguacggcauggagauccggcccgucaaggagaaggaggagaaccucgugaaguccauggugagcgccggcuccggggaggucgacagcuucucccugggccugcucugcaucagcaucaugaucgaggaggugaugcgcucccgguggagccgcaagaugcugaugaccgggacccuggccguguucuuccuccugaucaugggccagcugaccuggaacgaccucauccggcugugcaucauggucggggcgaacgccuccgaccgcaugggcaugggcacgaccuaccuggcccucauggccaccuucaagaugcgcccgauguucgccguggggcugcuguuccggcgccucaccagccgggaggugcugcugcucacgaucggccugucccuggucgcgagcguggagcuccccaacucccuggaggagcugggggacggccucgccaugggcaucaugauccugaagcugcucaccgacuuccagagccaccagcugugggccacccugcucucccugaccuucaucaagacgacccugagccuccacuacgccuggaagaccauggcgaugguccuguccaucgugagccuguucccccucugccuguccaccacgagccagaagaccaccuggcugcccgugcuccuggggucccugggcugcaagccgcucaccauguuccugaucgccgagaacaagaucugggggcgcaagagcuggccccugaacgagggcaucauggccgucgggaucgugagcauccuccuguccagccugcucaagaacgacgugccccuggccggcccccugaucgccggcgggaugcucaucgcgugcuacgucaucuccggcagcuccgccgaccugagccuggagaaggccgccgagguguccugggaggaggaggccgagcacagcggggcgucccacaacauccucguggagguccaggacgacggcacgaugaagaucaaggacgaggagcgggacgacacccugaccauccugcucaaggccacccugcuggccgugagcgggguguacccgcucuccauccccgccacccuguucgucugguacuucuggcagaagaagaagcagcgcagcggcgugcugugggacacgcccagcccgcccgagguggagcgggccguccuggacgacggcaucuaccgcaucaugcagcgggggcuccugggccgcagccaggugggggugggcgucuuccaggagaacguguuccacaccauguggcacgugacccgcggggccguccugauguaccagggcaagcgccucgagcccuccugggccagcgugaagaaggaccugaucuccuacggcgggggcuggcggcugcaggggagcuggaacaccggcgaggaggugcaggucaucgccguggagcccgggaagaaccccaagaacgugcagacggcccccggcaccuucaagacccccgagggcgaggucggggccaucgcgcucgacuucaagcccggcaccuccgggagccccaucgugaaccgcgagggcaagaucgugggccuguacgggaacggcgucgugacgaccagcgggaccuacguguccgccaucgcccaggccaaggcgagccaggagggcccgcugcccgagaucgaggacgaggucuuccggaagcgcaaccucaccaucauggaccugcaccccggguccggcaagacgcggcgcuaccugccggccaucgugcgggaggccaucaagcgcaagcuccggacccugauccuggcccccacccgcguggucgccagcgagauggcggaggcccucaagggcaugcccauccgcuaccagaccacggccgugaaguccgagcacaccgggaaggagaucguggaccugaugugccacgccaccuucaccaugcggcugcucagccccguccgcgugccgaacuacaacaugaucaucauggacgaggcccacuucacggaccccuccagcaucgcggcccggggcuacaucuccacccgcguggggaugggcgaggccgccgccaucuucaugaccgcgacgccgcccgggagcgucgaggccuucccgcaguccaacgccgugauccaggacgaggagcgggacauccccgagcgcagcuggaacuccggcuacgaguggaucacggacuuccccggcaagaccgugugguucguccccagcaucaaggccgggaacgacaucgcgaacugccugcggaagaacggcaagcgcgugauccagcugucccggaagaccuucgacaccgaguaccagaagacgaagaacaacgacugggacuacguggucaccaccgacaucagcgagaugggggccaacuuccgcgccgaccgggugaucgacccgcgccggugccucaagcccgugauccugaaggacggccccgagcgcgucauccuggccgggcccaugccggugaccgucgccuccgcggcccagcggcgcggccggaucggccgcaaccacaacaaggagggggaccaguacaucuacaugggccagccccucaacaacgacgaggaccacgcccacuggacggaggccaagaugcugcuggacaacaucaacacccccgaggggaucauccccgcccucuucgagccggagcgggagaaguccgcggccaucgacggcgaguaccgccugcgcggggaggcccggaagaccuucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcacguacuccgacccccuggcgcuccgggaguucaaggaguucgccgccgggcgccggagcgucuccggcgaccugauccuggagaucggcaagcucccgcagcaccugacccagcgcgcccagaacgcgcuggacaaccucgugaugcugcacaacagcgagcagggcgggcgggccuaccgccacgccauggaggagcugcccgacaccaucgagacccucaugcugcuggcccucaucgccgugcugaccgggggcgucacccuguucuuccucuccgggaagggccugggcaagaccagcaucgggcugcucugcgugauggcguccagcgugcugcuguggauggccuccgucgagccccacuggaucgccgccagcaucauccucgaguucuuccugauggugcugcucauccccgagccggaccggcagcgcacgccccaggacaaccagcuggccuacguggucaucggccuccuguucaugauccugaccguggcggccaacgagauggggcugcucgagacgaccaagaaggaccugggcaucgggcacguggccgucgagaaccaccaccacgccgccaugcuggacguggaccuccaccccgcguccgccuggacccuguacgccguggccaccacgaucaucaccccgaugaugcggcacaccaucgagaacaccacggccaacaucagccugaccgcgaucgccaaccaggccgccauccucaugggccuggacaagggcuggcccaucuccaagauggacaucggggucccccugcucgcgcugggcugcuacagccaggugaacccccugacccucaccgccgccgugcugaugcuggucgcccacuacgccaucaucgggccgggccuccaggcgaaggccacgcgcgaggcccagaagcggaccgccgccgggaucaugaagaaccccaccaucgacggcaucguggcgaucgaccuggaccccguggucuacgacgccaaguucgagaagcagcugggccagaucaugcuccugauccugugcaccucccagauccuccugaugcgcacgaccugggcccugugcgagagcaucacccucgccaccgggccccugacgacccugugggagggcuccccggggaaguucuggaacaccaccaucgccgugagcauggcgaacaucuuccgcggcuccuaccucgccggcgccgggcuggccuucagccugaugaagucccucggcgggggccggcgcgggacgggcgcgcagggcgagacccugggggagaaguggaagcggcagcugaaccagcucuccaagagcgaguucaacaccuacaagcgcuccggcaucauggagguggaccggagcgaggccaaggaggggcugaagcgcggcgagaccacgaagcacgccgucucccgggggaccgccaagcugcgcugguucguggagcggaaccuggugaagcccgagggcaaggucaucgaccucggcugcgggcgcggcggguggagcuacuacugcgccggccugaagaaggugaccgaggugaagggguacaccaagggcggccccgggcacgaggagcccaucccgauggcgacguacggcuggaaccuggucaagcuccacuccgggaaggacguguucuucaucccgcccgagaagugcgacacccugcugugcgacaucggcgagagcucccccaacccgaccaucgaggaggggcggacccuccgcgugcugaagauggucgagcccuggcugcggggcaaccaguucugcaucaagauccucaaccccuacaugcccagcgugguggagacgcuggagcagaugcagcgcaagcacggcgggaugcugguccggaacccgcucucccgcaacagcacccacgagauguacuggguguccugcggcaccgggaacaucgugagcgccgucaacaugaccucccggaugcugcugaaccgcuucaccauggcccaccggaagcccacguacgagcgcgacguggaccucggcgccggcacccgccacguggccgucgagcccgagguggcgaaccuggacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcucacgaagcccugggacgugauccccauggugacccagaucgccaugaccgacaccacgcccuucgggcagcagcgcgucuucaaggagaagguggacacccggaccccgaaggccaagcgcggcaccgcgcagaucauggaggugacggccaaguggcuguggggcuuccugucccggaacaagaagccccgcaucugcacccgggaggaguucacccgcaagguccggagcaacgccgccaucggggcgguguucguggacgagaaccaguggaacuccgccaaggaggccgucgaggacgaccgcuucugggaccucgugcaccgggagcgcgagcugcacaagcagggcaagugcgcgaccugcguguacaacaugauggggaagcgggagaagaagcugggcgaguucgggaaggccaagggcagccgcgcgaucugguacauguggcucggcgcccgguuccuggaguucgaggcccugggguucaugaacgaggaccacugguucucccgcgagaacagccucuccggcgucgagggggagggccugcacaagcugggguacauccuccgggacaucagcaagauccccggcggcaacauguacgccgacgacacggccgggugggacacccgcaucaccgaggacgaccugcagaacgaggcgaagaucaccgacaucauggagccggagcacgcccugcucgccaaguccaucuucaagcugacguaccagaacaagguggugcggguccagcgccccgccaagaacggcaccgugauggacgugaucagccggcgcgaccagcgcggguccggccaggucggcaccuacgggcugaacaccuucacgaacauggaggcccagcucauccggcagauggagagcgagggcaucuucucccccaacgagcuggagacccccaaccuggcggagcgcgugcucgacuggcuggagaaguacgggguggagcggcugaagcgcauggccaucagcggcgacgacugcgucgugaagccgaucgacgaccgguucgccaccgcccucaccgcccugaacgacauggggaaggugcgcaaggacaucccccagugggagcccuccaagggcuggaacgacuggcagcagguccccuucugcagccaccacuuccaccagcugaucaugaaggacggccgggagaucguggugccgugccgcaaccaggacgagcucgucgggcgggcgcgcgugucccagggcgccggguggagccugcgggagacggccugccugggcaagagcuacgcccagauguggcagcucauguacuuccaccgccgggaccugcgccuggcggccaacgccaucugcuccgccgugcccgucgacugggugcccaccagccggaccaccugguccauccacgcccaccaccaguggaugacgaccgaggacaugcucagcguguggaaccgcgucuggaucgaggagaaccccuggauggaggacaagacccggaucuccagcugggaggacgugccguaccuggggaagcgcgaggaccaguggugcggcucccugaucggccucaccgcgcgggccacgugggccaccaacauccagguggccaucaaccagguccgccgccugaucgggaacgagaacuacagcgacuacaugaccuccaugaagcgguucaagaacgagagcgagcccgagggcgcccugugguga

SEQ ID NO: 8196 - RNA, 9879 nt, Artificial Sequence
  derived and/or modified CDS sequence (opt1) from DENV-1__FJ687428__SS-prME
agcgugaccaugcugcucaugcugaugcccaccgcccuggccuuccaccucaccacccggggcggggagccccacaugaucgucagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgggcgccuccuucaucgaggucaagaccugcaucuggcccaagagccacacccucugguccaacggggugcuggagagcgagaugaucauccccaagaucuacggcgggccgaucucccagcacaacuaccggcccggcuacuucacgcagaccgccgggcccuggcaccugggcaagcucgagcuggacuucgaccugugcgagggcaccaccguggucguggacgagcacugcgggaaccgcggcccgagccuccggacgaccaccgugaccgggaagaucauccacgaguggugcugccgcuccugcacgcugccgccccugcgguuccgcggcgaggacgggugcugguacggcauggagauccggcccgucaaggagaaggaggagaaccucgugaaguccauggugagcgccggcuccggggaggucgacagcuucucccugggccugcucugcaucagcaucaugaucgaggaggugaugcgcucccgguggagccgcaagaugcugaugaccgggacccuggccguguucuuccuccugaucaugggccagcugaccuggaacgaccucauccggcugugcaucauggucggggcgaacgccuccgaccgcaugggcaugggcacgaccuaccuggcccucauggccaccuucaagaugcgcccgauguucgccguggggcugcuguuccggcgccucaccagccgggaggugcugcugcucacgaucggccugucccuggucgcgagcguggagcuccccaacucccuggaggagcugggggacggccucgccaugggcaucaugauccugaagcugcucaccgacuuccagagccaccagcugugggccacccugcucucccugaccuucaucaagacgacccugagccuccacuacgccuggaagaccauggcgaugguccuguccaucgugagccuguucccccucugccuguccaccacgagccagaagaccaccuggcugcccgugcuccuggggucccugggcugcaagccgcucaccauguuccugaucgccgagaacaagaucugggggcgcaagagcuggccccugaacgagggcaucauggccgucgggaucgugagcauccuccuguccagccugcucaagaacgacgugccccuggccggcccccugaucgccggcgggaugcucaucgcgugcuacgucaucuccggcagcuccgccgaccugagccuggagaaggccgccgagguguccugggaggaggaggccgagcacagcggggcgucccacaacauccucguggagguccaggacgacggcacgaugaagaucaaggacgaggagcgggacgacacccugaccauccugcucaaggccacccugcuggccgugagcgggguguacccgcucuccauccccgccacccuguucgucugguacuucuggcagaagaagaagcagcgcagcggcgugcugugggacacgcccagcccgcccgagguggagcgggccguccuggacgacggcaucuaccgcaucaugcagcgggggcuccugggccgcagccaggugggggugggcgucuuccaggagaacguguuccacaccauguggcacgugacccgcggggccguccugauguaccagggcaagcgccucgagcccuccugggccagcgugaagaaggaccugaucuccuacggcgggggcuggcggcugcaggggagcuggaacaccggcgaggaggugcaggucaucgccguggagcccgggaagaaccccaagaacgugcagacggcccccggcaccuucaagacccccgagggcgaggucggggccaucgcgcucgacuucaagcccggcaccuccgggagccccaucgugaaccgcgagggcaagaucgugggccuguacgggaacggcgucgugacgaccagcgggaccuacguguccgccaucgcccaggccaaggcgagccaggagggcccgcugcccgagaucgaggacgaggucuuccggaagcgcaaccucaccaucauggaccugcaccccggguccggcaagacgcggcgcuaccugccggccaucgugcgggaggccaucaagcgcaagcuccggacccugauccuggcccccacccgcguggucgccagcgagauggcggaggcccucaagggcaugcccauccgcuaccagaccacggccgugaaguccgagcacaccgggaaggagaucguggaccugaugugccacgccaccuucaccaugcggcugcucagccccguccgcgugccgaacuacaacaugaucaucauggacgaggcccacuucacggaccccuccagcaucgcggcccggggcuacaucuccacccgcguggggaugggcgaggccgccgccaucuucaugaccgcgacgccgcccgggagcgucgaggccuucccgcaguccaacgccgugauccaggacgaggagcgggacauccccgagcgcagcuggaacuccggcuacgaguggaucacggacuuccccggcaagaccgugugguucguccccagcaucaaggccgggaacgacaucgcgaacugccugcggaagaacggcaagcgcgugauccagcugucccggaagaccuucgacaccgaguaccagaagacgaagaacaacgacugggacuacguggucaccaccgacaucagcgagaugggggccaacuuccgcgccgaccgggugaucgacccgcgccggugccucaagcccgugauccugaaggacggccccgagcgcgucauccuggccgggcccaugccggugaccgucgccuccgcggcccagcggcgcggccggaucggccgcaaccacaacaaggagggggaccaguacaucuacaugggccagccccucaacaacgacgaggaccacgcccacuggacggaggccaagaugcugcuggacaacaucaacacccccgaggggaucauccccgcccucuucgagccggagcgggagaaguccgcggccaucgacggcgaguaccgccugcgcggggaggcccggaagaccuucguggagcugaugcgccggggcgaccuccccguguggcuguccuacaaggucgccagcgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcacguacuccgacccccuggcgcuccgggaguucaaggaguucgccgccgggcgccggagcgucuccggcgaccugauccuggagaucggcaagcucccgcagcaccugacccagcgcgcccagaacgcgcuggacaaccucgugaugcugcacaacagcgagcagggcgggcgggccuaccgccacgccauggaggagcugcccgacaccaucgagacccucaugcugcuggcccucaucgccgugcugaccgggggcgucacccuguucuuccucuccgggaagggccugggcaagaccagcaucgggcugcucugcgugauggcguccagcgugcugcuguggauggccuccgucgagccccacuggaucgccgccagcaucauccucgaguucuuccugauggugcugcucauccccgagccggaccggcagcgcacgccccaggacaaccagcuggccuacguggucaucggccuccuguucaugauccugaccguggcggccaacgagauggggcugcucgagacgaccaagaaggaccugggcaucgggcacguggccgucgagaaccaccaccacgccgccaugcuggacguggaccuccaccccgcguccgccuggacccuguacgccguggccaccacgaucaucaccccgaugaugcggcacaccaucgagaacaccacggccaacaucagccugaccgcgaucgccaaccaggccgccauccucaugggccuggacaagggcuggcccaucuccaagauggacaucggggucccccugcucgcgcugggcugcuacagccaggugaacccccugacccucaccgccgccgugcugaugcuggucgcccacuacgccaucaucgggccgggccuccaggcgaaggccacgcgcgaggcccagaagcggaccgccgccgggaucaugaagaaccccaccaucgacggcaucguggcgaucgaccuggaccccguggucuacgacgccaaguucgagaagcagcugggccagaucaugcuccugauccugugcaccucccagauccuccugaugcgcacgaccugggcccugugcgagagcaucacccucgccaccgggccccugacgacccugugggagggcuccccggggaaguucuggaacaccaccaucgccgugagcauggcgaacaucuuccgcggcuccuaccucgccggcgccgggcuggccuucagccugaugaagucccucggcgggggccggcgcgggacgggcgcgcagggcgagacccugggggagaaguggaagcggcagcugaaccagcucuccaagagcgaguucaacaccuacaagcgcuccggcaucauggagguggaccggagcgaggccaaggaggggcugaagcgcggcgagaccacgaagcacgccgucucccgggggaccgccaagcugcgcugguucguggagcggaaccuggugaagcccgagggcaaggucaucgaccucggcugcgggcgcggcggguggagcuacuacugcgccggccugaagaaggugaccgaggugaagggguacaccaagggcggccccgggcacgaggagcccaucccgauggcgacguacggcuggaaccuggucaagcuccacuccgggaaggacguguucuucaucccgcccgagaagugcgacacccugcugugcgacaucggcgagagcucccccaacccgaccaucgaggaggggcggacccuccgcgugcugaagauggucgagcccuggcugcggggcaaccaguucugcaucaagauccucaaccccuacaugcccagcgugguggagacgcuggagcagaugcagcgcaagcacggcgggaugcugguccggaacccgcucucccgcaacagcacccacgagauguacuggguguccugcggcaccgggaacaucgugagcgccgucaacaugaccucccggaugcugcugaaccgcuucaccauggcccaccggaagcccacguacgagcgcgacguggaccucggcgccggcacccgccacguggccgucgagcccgagguggcgaaccuggacaucaucgggcagcggaucgagagcaucaagcacgagcacaaguccaccuggcacuacgacgaggacaaccccuacaagaccugggccuaccacggcagcuacgaggugaagccguccgggagcgccagcuccauggucaacggcguggucaagcugcucacgaagcccugggacgugauccccauggugacccagaucgccaugaccgacaccacgcccuucgggcagcagcgcgucuucaaggagaagguggacacccggaccccgaaggccaagcgcggcaccgcgcagaucauggaggugacggccaaguggcuguggggcuuccugagccggaacaagaagccccgcaucugcacccgggaggaguucacccgcaagguccgguccaacgccgccaucggggcgguguucguggacgagaaccaguggaacagcgccaaggaggccgucgaggacgaccgcuucugggaccucgugcaccgggagcgcgagcugcacaagcagggcaagugcgcgaccugcguguacaacaugauggggaagcgggagaagaagcugggcgaguucgggaaggccaagggcucccgcgcgaucugguacauguggcucggcgcccgguuccuggaguucgaggcccugggguucaugaacgaggaccacugguucagccgcgagaacucccucagcggcgucgagggggagggccugcacaagcugggguacauccuccgggacaucuccaagauccccggcggcaacauguacgccgacgacacggccgggugggacacccgcaucaccgaggacgaccugcagaacgaggcgaagaucaccgacaucauggagccggagcacgcccugcucgccaagagcaucuucaagcugacguaccagaacaagguggugcggguccagcgccccgccaagaacggcaccgugauggacgugaucucccggcgcgaccagcgcgggagcggccaggucggcaccuacgggcugaacaccuucacgaacauggaggcccagcucauccggcagauggaguccgagggcaucuucagccccaacgagcuggagacccccaaccuggcggagcgcgugcucgacuggcuggagaaguacgggguggagcggcugaagcgcauggccaucuccggcgacgacugcgucgugaagccgaucgacgaccgguucgccaccgcccucaccgcccugaacgacauggggaaggugcgcaaggacaucccccagugggagcccagcaagggcuggaacgacuggcagcagguccccuucugcucccaccacuuccaccagcugaucaugaaggacggccgggagaucguggugccgugccgcaaccaggacgagcucgucgggcgggcgcgcgugagccagggcgccggguggagccugcgggagacggccugccugggcaaguccuacgcccagauguggcagcucauguacuuccaccgccgggaccugcgccuggcggccaacgccaucugcagcgccgugcccgucgacugggugcccaccucccggaccaccuggagcauccacgcccaccaccaguggaugacgaccgaggacaugcucuccguguggaaccgcgucuggaucgaggagaaccccuggauggaggacaagacccggaucagcuccugggaggacgugccguaccuggggaagcgcgaggaccaguggugcggcagccugaucggccucaccgcgcgggccacgugggccaccaacauccagguggccaucaaccagguccgccgccugaucgggaacgagaacuacuccgacuacaugaccagcaugaagcgguucaagaacgaguccgagcccgagggcgcccugugguga

SEQ ID NO: 8197 - RNA, 9879 nt, Artificial Sequence
  derived and/or modified CDS sequence (opt1) from DENV-1__FJ687429__SS-prME
agcgugaccaugcugcugaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgggacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggaucgacgugguccuggagcacgggagcugcaucaccaccauggccaaggacaagcccacccuggacaucgagcuccugaagacggaggugaccaaccccgcggugcugcggaagcucugcaucgaggccaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccuccugacgugcgccaaguucaagugcgucaccaagcuggagggcaagaucgugcaguacgagaaccucaaguacagcgugaucgucaccgugcacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgucaccuucaagaccgcccacgcgaagaagcaggagguggugguccugggcagccaggagggcgccaugcacaccgcccugacgggggccaccgagauccagaccuccggcaccacgaccaucuucgccgggcaccucaagugccgccugaagauggacaagcugacccucaagggcaugagcuacgugaugugcaccggguccuucaagcuggagaaggagguggcggagacgcagcacggcaccguccuggugcagaucaaguacgagggcaccgacgcccccugcaagauccccuucagcacccaggacgagaagggggugacgcagaacggccggcugaucaccgccaacccgaucgucaccgacaaggagaagcccgugaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgccgucgggcuggugacccuguaccucggcgugaugguccaggccgacuccgggugcgugaucaacuggaagggccgggagcugaagugcgggagcggcaucuucgugacgaacgagguccacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccguggucgugggggacguggcgggcauccuggcccaggggaagaagaugauccggccccagcccauggaguacaaguacagcuggaaguccuggggcaaggccaagaucaucggcgccgacguccagaacagcacguucaucaucgacgggcccaacaccccggagugccccgacgaccagcgcgcguggaacaucugggagguggaggacuacggcuucgggaucuucaccaccaacaucuggcugaagcuccgggacuccuacacccaggugugcgaccaccgccugaugagcgccgccaucaaggacuccaaggccguccacgccgacaugggcuacuggaucgagagcgagaagaacgagaccuggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugaaguccauggucagcgccggcuccggcgagguggacagcuucucccuggggcugcucugcaucagcaucaugaucgaggaggugaugcggucccgcuggagccggaagaugcugaugaccggcacccuggccgucuucuuccuccugaucauggggcagcugaccuggaacgaccucauccgccugugcaucauggugggcgcgaacgccuccgaccgcauggggaugggcacgaccuaccuggcccucauggccaccuucaagaugcggccgauguucgccgugggccugcuguuccgccggcucaccagccgcgagguccugcugcucacgaucgggcugucccugguggcgagcguggagcuccccaacucccuggaggagcugggcgacgggcucgccaugggcaucaugauccugaagcugcucaccgacuuccagagccaccagcugugggccacccugcucucccugaccuucaucaagacgaccuucagccugcacuacgccuggaagaccauggcgaugguccucuccaucgugagccuguucccccugugccucuccaccacgagccagaagaccaccuggcugcccguccugcucggcucccuggggugcaagccgcugaccauguuccucaucgccgagaacaagaucuggggccgcaagagcuggccccugaacgaggggaucauggccgugggcaucgugagcauccugcucuccagccugcugaagaacgacgucccccucgccgggccccugaucgccggcggcaugcugaucgcgugcuacgugaucuccgggagcuccgccgaccucagccuggagaaggccgccgagguguccugggaggaggaggccgagcacagcggcgcgucccacaacauccuggucgaggugcaggacgacgggacgaugaagaucaaggacgaggagcgcgacgacacccucaccauccugcugaaggccacccuccuggccgugagcggcgucuacccgcuguccauccccgccacccucuucgugugguacuucuggcagaagaagaagcagcggagcggggugcugugggacacgcccagcccgcccgaggucgagcgcgccgugcuggacgacggcaucuaccggaucaugcagcgcggccugcucgggcggagccaggugggcgucgggguguuccaggagaacguguuccacaccauguggcacgucacccgcggcgcggugcugauguaccaggggaagcggcuggagcccuccugggccagcgugaagaaggaccucaucuccuacggcggcggguggcgccugcagggcagcuggaacaccggggaggagguccaggugaucgccguggagcccggcaagaaccccaagaacguccagacggcccccgggaccuucaagacccccgagggcgaggugggcgccaucgcgcuggacuucaagcccgggaccuccggcagccccaucgugaaccgggaggggaagaucgucggccucuacggcaacgggguggugacgaccagcggcaccuacgucuccgccaucgcccaggccaaggcgagccaggaggggccgcugcccgagaucgaggacgagguguuccgcaagcggaaccugaccaucauggaccuccaccccggcuccgggaagacgcgccgguaccugccggccaucgugcgcgaggccaucaagcggaagcugcgcacccucauccuggcccccacccgcgucguggccagcgagauggcggaggcccugaagggcaugcccauccgguaccagaccacggccgugaaguccgagcacaccggcaaggagaucgucgaccucaugugccacgccaccuucaccaugcgccugcugagccccgugcgggugccgaacuacaacaugaucaucauggacgaggcccacuucacggaccccuccagcaucgcggcccgcggguacaucuccacccgggucggcaugggggaggccgccgccaucuucaugaccgcgacgccgcccggcagcguggaggccuucccgcaguccaacgccgugauccaggacgaggagcgcgacauccccgagcggagcuggaacuccggguacgaguggaucacggacuuccccggcaagaccgucugguucgugcccagcaucaaggccggcaacgacaucgcgaacugccuccgcaagaacgggaagcgggugauccagcugucccgcaagaccuucgacaccgaguaccagaagacgaagaacaacgacugggacuacgucgugaccaccgacaucagcgagaugggcgccaacuuccgggccgaccgcgugaucgacccgcggcgcugccugaagcccgucauccucaaggacgggcccgagcgggugauccuggccggccccaugccggugaccgucgccuccgcggcccagcgccgggggcgcaucggccggaaccacaacaaggagggcgaccaguacaucuacauggggcagccccugaacaacgacgaggaccacgcccacuggacggaggccaagaugcuccuggacaacaucaacacccccgagggcaucauccccgcccuguucgagccggagcgcgagaaguccgcggccaucgacggggaguaccgccuccggggcgaggcccgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggaccaaggagggggagcgcaagaagcugcggccccgcuggcucgacgcccggacguacuccgacccccuggcgcugcgcgaguucaaggaguucgccgccggccggcgcagcguguccggggaccucauccuggagaucggcaagcugccgcagcaccucacccagcgggcccagaacgcgcuggacaaccuggugaugcuccacaacagcgagcagggcgggcgcgccuaccggcacgccauggaggagcugcccgacaccaucgagacccugaugcuccuggcccugaucgccguccucacgggcggggugacccuguucuuccuguccggcaaggggcucggcaagaccagcaucggccugcugugcgugauggcguccagcguccuccuguggauggccuccguggagccccacuggaucgccgccagcaucauccuggaguucuuccucauggugcugcugauccccgagccggaccgccagcggacgccccaggacaaccagcucgccuacgucgugaucgggcugcuguucaugauccucaccguggcggccaacgagaugggccugcuggagacgaccaagaaggaccucgggaucggccacgucgccguggagaaccaccaccacgccgccaugcuggacguggaccugcaccccgcguccgccuggacccucuacgccgucgccaccacgaucaucaccccgaugaugcgccacaccaucgagaacaccacggccaacaucagccugaccgcgaucgccaaccaggccgccauccugauggggcucgacaagggcuggcccaucuccaagauggacaucggcgugccccugcuggcgcucgggugcuacagccaggugaacccccugacccugaccgccgccguccucaugcugguggcccacuacgccaucaucggcccggggcugcaggcgaaggccacgcgggaggcccagaagcgcaccgccgccggcaucaugaagaaccccaccaucgacgggaucguggcgaucgaccucgaccccgucguguacgacgccaaguucgagaagcagcugggccagaucaugcugcucauccugugcaccucccagauccugcucaugcgcacgaccugggcccugugcgagagcaucacccuggccaccggcccccucacgacccugugggagggguccccgggcaaguucuggaacaccaccaucgccgugagcauggcgaacaucuuccggggguccuaccuggccggcgccggccucgccuucagccugaugaagucccucgggggcgggcgccgggggacgggggcgcagggcgagacccucggcgagaaguggaagcgccagcugaaccagcuguccaagagcgaguucaacaccuacaagcgguccgggaucauggaggucgaccgcagcgaggccaaggagggccucaagcgcggggagaccacgaagcacgccgugucccgcggcaccgccaagcugcggugguucguggagcgcaaccuggucaagcccgaggggaaggugaucgaccugggcugcggccgcggcggguggagcuacuacugcgccgggcucaagaaggugaccgaggucaagggguacaccaagggcggccccggccacgaggagcccaucccgauggcgacguacggguggaaccuggugaagcugcacuccggcaaggacguguucuucaucccgcccgagaagugcgacacccuccugugcgacaucggggagagcucccccaacccgaccaucgaggagggccgcacccugcggguccucaagaugguggagcccuggcugcgcgggaaccaguucugcaucaagauccugaaccccuacaugcccagcguggucgagacgcucgagcagaugcagcggaagcacggcggcaugcuggugcgcaacccgcugucccggaacagcacccacgagauguacuggguguccugcgggaccggcaacaucgucagcgccgugaacaugaccucccgcaugcuccugaaccgguucaccauggcccaccgcaagcccacguacgagcgcgacguggaccugggggccggcacccggcacgucgccguggagcccgagguggcgaaccucgacaucaucggccagcgcaucgagaacaucaagcacgagcacaagagcaccuggcacuacgacgaggacaaccccuacaagaccugggccuaccacggguccuacgaggucaagccgagcggcuccgccagcagcauggugaacgggguggucaagcugcugacgaagcccugggacgugauccccauggucacccagaucgccaugaccgacaccacgcccuucggccagcagcggguguucaaggagaagguggacacccgcaccccgaaggccaagcgggggaccgcgcagaucauggaggucacggcccgcuggcucuggggcuuccugucccggaacaagaagccccgcaucugcacccgggaggaguucacccgcaaggugcggagcaacgccgccaucggcgcgguguucgucgacgagaaccaguggaacuccgccaaggaggccguggaggacgaccgcuucugggaccuggugcaccgggagcgcgagcuccacaagcaggggaagugcgcgaccugcgucuacaacaugaugggcaagcgggagaagaagcugggggaguucggcaaggccaaggggagccgcgcgaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacacggccggcugggacacccgcaucaccgaggacgaccuccagaacgaggcgaagaucaccgacaucauggagccggagcacgcccugcuggccaaguccaucuucaagcucacguaccagaacaaggugguccgggugcagcgccccgccaagaacgggaccgugauggacgucaucagccgccgggaccagcgcggcuccggccagguggggaccuacggccugaacaccuucacgaacauggaggcccagcugauccggcagauggagagcgaggggaucuucucccccaacgagcucgagacccccaaccuggcggagcgcgugcuggacuggcucgagaaguacggcgucgagcggcugaagcgcauggccaucagcggggacgacugcguggugaagccgaucgacgaccgguucgccaccgcccugaccgcccucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcgcgcgugucccagggggccggcuggagccuccgggagacggccugccugggcaagagcuacgcccagauguggcagcugauguacuuccaccgccgggaccuccgccuggcggccaacgccaucugcuccgccguccccguggacugggugcccaccagccggaccaccugguccauccacgcccaccaccaguggaugacgaccgaggacaugcugagcgucuggaaccgcguguggaucgaggagaaccccuggauggaggacaagacccggaucuccagcugggaggacgugccguaccucggcaagcgcgaggaccaguggugcgggucccugaucggccugaccgcgcgcgccacgugggccaccaacauccaggucgccaucaaccaggugcggcgccucaucggcaacgagaacuacagcgacuacaugaccuccaugaagcgguucaagaacgagagcgagcccgagggggcccugugguga

SEQ ID NO: 8198 - RNA, 9879 nt, Artificial Sequence
  derived and/or modified CDS sequence (opt1) from DENV-1__FJ850068__SS-prME
agcgugaccaugcugcucaugcugaugcccaccgcccuggccuuccaccucaccacccggggcggggagccccacaugaucgucagcaagcaggagcggggcaagagccugcuguucaagaccagcgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggaguacaaguacagcuggaaguccuggggcaaggccaagaucaucggcgccgacgugcagaacagcacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgggcgccuccuucaucgaggucaagaccugcaucuggcccaagagccacacccucugguccaacggggugcuggagagcgagaugaucauccccaagaucuacggcgggccgaucucccagcacaacuaccggcccggcuacuucacgcagaccgccgggcccuggcaccugggcaagcucgagcuggacuucgaccugugcgagggcaccaccguggucguggacgagcacugcgggaaccgcggcccgagccuccggacgaccaccgugaccgggaagaucauccacgaguggugcugccgcuccugcacgcugccgccccugcgguuccgcggcgaggacgggugcugguacggcauggagauccggcccgucaaggagaaggaggagaaccucgugaaguccauggugagcgccggcuccggggaggucgacagcuucucccugggccugcucugcaucagcaucaugaucgaggaggugaugcgcucccgguggagccgcaagaugcugaugaccgggacccuggccguguucuuccuccugaucaugggccagcugaccuggaacgaccucauccggcugugcaucauggucggggcgaacgccuccgaccgcaugggcaugggcacgaccuaccuggcccucauggccaccuucaagaugcgcccgauguucgccguggggcugcuguuccggcgccucaccagccgggaggugcugcugcucacgaucggccugucccuggucgcgagcguggagcuccccaacucccuggaggagcugggggacggccucgccaugggcaucaugauccugaagcugcucaccgacuuccagagccaccagcugugggccacccugcucucccugaccuucaucaagacgaccuucagccugcacuacgccuggaagaccauggcgaugguccucuccaucgugagccuguucccccugugccucuccaccacgagccagaagaccaccuggcugcccgugcugcucgggucccugggcugcaagccgcugaccauguuccucaucgccgagaacaagaucugggggcgcaagagcuggccccugaacgagggcaucauggccgucgggaucgugagcauccugcucuccagccugcugaagaacgacgugccccucgccggcccccugaucgccggcgggaugcugaucgcgugcuacgucaucuccggcagcuccgccgaccucagccuggagaaggccgccgagguguccugggaggaggaggccgagcacagcggggcgucccacaacauccugguggagguccaggacgacggcacgaugaagaucaaggacgaggagcgggacgacacccucaccauccugcugaaggccacccuccuggccgugagcgggguguacccgcuguccauccccgccacccucuucgucugguacuucuggcagaagaagaagcagcgcagcggcgugcugugggacacgcccagcccgcccgagguggagcgggccguccuggacgacggcaucuaccgcaucaugcagcgggggcugcucggccgcagccaggugggggugggcgucuuccaggagaacguguuccacaccauguggcacgugacccgcggggccguccugauguaccagggcaagcgccuggagcccuccugggccagcgugaagaaggaccucaucuccuacggcgggggcuggcggcugcaggggagcuggaacaccggcgaggaggugcaggucaucgccguggagcccgggaagaaccccaagaacgugcagacggcccccggcaccuucaagacccccgagggcgaggucggggccaucgcgcuggacuucaagcccggcaccuccgggagccccaucgugaaccgcgagggcaagaucgugggccucuacgggaacggcgucgugacgaccagcgggaccuacguguccgccaucgcccaggccaaggcgagccaggagggcccgcugcccgagaucgaggacgaggucuuccggaagcgcaaccugaccaucauggaccuccaccccggguccggcaagacgcggcgcuaccugccggccaucgugcgggaggccaucaagcgcaagcugcggacccucauccuggcccccacccgcguggucgccagcgagauggcggaggcccugaagggcaugcccauccgcuaccagaccacggccgugaaguccgagcacaccgggaaggagaucguggaccucaugugccacgccaccuucaccaugcggcugcugagccccguccgcgugccgaacuacaacaugaucaucauggacgaggcccacuucacggaccccuccagcaucgcggcccggggcuacaucuccacccgcguggggaugggcgaggccgccgccaucuucaugaccgcgacgccgcccgggagcgucgaggccuucccgcaguccaacgccgugauccaggacgaggagcgggacauccccgagcgcagcuggaacuccggcuacgaguggaucacggacuuccccggcaagaccgugugguucguccccagcaucaaggccgggaacgacaucgcgaacugccuccggaagaacggcaagcgcgugauccagcugucccggaagaccuucgacaccgaguaccagaagacgaagaacaacgacugggacuacguggucaccaccgacaucagcgagaugggggccaacuuccgcgccgaccgggugaucgacccgcgccggugccugaagcccgugauccucaaggacggccccgagcgcgucauccuggccgggcccaugccggugaccgucgccuccgcggcccagcggcgcggccggaucggccgcaaccacaacaaggagggggaccaguacaucuacaugggccagccccugaacaacgacgaggaccacgcccacuggacggaggccaagaugcuccuggacaacaucaacacccccgaggggaucauccccgcccuguucgagccggagcgggagaaguccgcggccaucgacggcgaguaccgccuccgcggggaggcccggaagaccuucguggagcugaugcgccggggcgaccugcccguguggcucuccuacaaggucgccagcgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcacguacuccgacccccuggcgcugcgggaguucaaggaguucgccgccgggcgccggagcgucuccggcgaccucauccuggagaucggcaagcugccgcagcaccucacccagcgcgcccagaacgcgcuggacaaccuggugaugcuccacaacagcgagcagggcgggcgggccuaccgccacgccauggaggagcugcccgacaccaucgagacccugaugcuccuggcccugaucgccgugcucaccgggggcgucacccuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagacgaccaagaaggaccucggcaucgggcacguggccgucgagaaccaccaccacgccgccaugcuggacguggaccugcaccccgcguccgccuggacccucuacgccguggccaccacgaucaucaccccgaugaugcggcacaccaucgagaacaccacggccaacaucagccugaccgcgaucgccaaccaggccgccauccugaugggccucgacaagggcuggcccaucuccaagauggacaucggggucccccugcuggcgcucggcugcuacagccaggugaacccccugacccugaccgccgccgugcucaugcuggucgcccacuacgccaucaucgggccgggccugcaggcgaaggccacgcgcgaggcccagaagcggaccgccgccgggaucaugaagaaccccaccaucgacggcaucguggcgaucgaccucgaccccguggucuacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggcgaacaucuuccgcggcuccuaccuggccggcgccgggcucgccuucagccugaugaagucccugggcgggggccggcgcgggacgggcgcgcagggcgagacccucggggagaaguggaagcggcagcugaaccagcuguccaagagcgaguucaacaccuacaagcgcuccggcaucauggagguggaccggagcgaggccaaggaggggcucaagcgcggcgagaccacgaagcacgccgucucccgggggaccgccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggcgacguacggcuggaaccuggucaagcugcacuccgggaaggacguguucuucaucccgcccgagaagugcgacacccuccugugcgacaucggcgagagcucccccaacccgaccaucgaggaggggcggacccugcgcgugcucaagauggucgagcccuggcugcggggcaaccaguucugcaucaagauccugaaccccuacaugcccagcgugguggagacgcucgagcagaugcagcgcaagcacggcgggaugcugguccggaacccgcugucccgcaacagcacccacgagauguacuggguguccugcggcaccgggaacaucgugagcgccgucaacaugaccucccggaugcuccugaaccgcuucaccauggcccaccggaagcccacguacgagcgcgacguggaccugggcgccggcacccgccacguggccgucgagcccgagguggcgaaccucgacaucaucgggcagcggaucgagaacaucaagcacgagcacaagagcaccuggcacuacgacgaggacaaccccuacaagaccugggccuaccacggcuccuacgaggugaagccgagcggguccgccagcagcauggucaacggcguggucaagcugcugacgaagcccugggacgugauccccauggugacccagaucgccaugaccgacaccacgcccuucgggcagcagcgcgucuucaaggagaagguggacacccggaccccgaaggccaagcgcggcaccgcgcagaucauggaggugacggcccgguggcucuggggcuuccugucccgcaacaagaagccccggaucugcacccgcgaggaguucacccggaagguccgcagcaacgccgccaucggggcgguguucguggacgagaaccaguggaacuccgccaaggaggccgucgaggacgaccgguucugggaccuggugcaccgcgagcgggagcuccacaagcagggcaagugcgcgaccugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagauccccggcggcaacauguacgccgacgacacggccgggugggacacccggaucaccgaggacgaccuccagaacgaggcgaagaucaccgacaucauggagccggagcacgcccugcuggccaaguccaucuucaagcucacguaccagaacaagguggugcgcguccagcggcccgccaagaacggcaccgugauggacgugaucagccgccgcgaccagcggggguccggccaggucggcaccuacgggcugaacaccuucacgaacauggaggcccagcugauccgccagauggagagcgagggcaucuucucccccaacgagcucgagacccccaaccuggcggagcgggugcuggacuggcucgagaaguacgggguggagcgccugaagcggauggccaucagcggcgacgacugcgucgugaagccgaucgacgaccgcuucgccaccgcccugaccgcccucaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcuggucgggcgcgcgcgggugucccagggcgccggguggagccuccgcgagacggccugccugggcaagagcuacgcccagauguggcagcugauguacuuccaccggcgcgaccuccggcuggcggccaacgccaucugcuccgccgugcccgucgacugggugcccaccagccgcaccaccugguccauccacgcccaccaccaguggaugacgaccgaggacaugcugagcguguggaaccgggucuggaucgaggagaaccccuggauggaggacaagacccgcaucuccagcugggaggacgugccguaccucgggaagcgggaggaccaguggugcggcucccugaucggccugaccgcgcgcgccacgugggccaccaacauccagguggccaucaaccagguccgccggcucaucgggaacgagaacuacagcgacuacaugaccuccaugaagcgcuucaagaacgagagcgagcccgagggcgcccugugguga

SEQ ID NO: 8199 - RNA, 9879 nt, Artificial Sequence
  derived and/or modified CDS sequence (opt1) from DENV-1__FJ687430__SS-prME
agcgugaccaugcugcucaugcugaugcccaccgcccuggccuuccaccucaccacccggggcggggagccccacaugaucgugagcaagcaggagcggggcaagagccugcuguucaagaccuccaccggggugaacaugugcacccucaucgccauggaccugggcgagcugugcgaggacaccaugaccuacaagugcccccgcaucaccgaggccgagcccgacgacguggacugcuggugcaacgccacggacaccugggucaccuacgggaccugcagccagacgggcgagcaccggcgcgacaagcgguccguggcccucgcgccccacgugggccuggggcuggagacccgcaccgagaccuggaugagcuccgagggcgcguggaagcagauccagaaggucgagacgugggcccuccggcaccccggguucaccgugaucgcccuguuccuggcccacgcgaucggcaccagcaucacccagaaggggaucaucuucauccuccugaugcuggugacgcccuccauggccaugcgcugcgucggcaucggcagccgggacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcgcaagcucugcaucgaggcgaagaucuccaacaccacgaccgacagccggugcccgacccagggcgaggccacccugguggaggagcaggacgccaacuucgucugccgccggacguucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccagcggggccagcacgucccaggagaccuggaaccgccaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgucaugugcacgggguccuucaagcucgagaaggagguggccgagacccagcacggcaccauccuggugcagaucaaguacgagggcaccgacgcgcccugcaagauccccuucagcacgcaggacgagaagggggucacccagaacggccgccugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccgccggauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgcgagcucaagugcgggagcggcaucuucgucaccaacgaggugcacaccuggaccgagcaguacaaguuccaggccgacagcccgaagcggcuguccgcggccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgccggcauccucgcgcaggggaagaagaugauccgcccccagcccauggaguacaaguacagcuggaaguccuggggcaaggccaagaucaucggcgccgacgugcagaacgccaccuucaucaucgacgggcccaacaccccggagugccccgacgaccagcgggcguggaacaucugggagguggaggacuacggcuucgggaucuucaccacgaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguucuuccugcucaucauggggcagcugacguggaacgaccugauccggcucugcaucauggugggcgcgaacgccagcgacaagauggggaugggcaccaccuaccuggcccugauggccaccuucaagaugcgcccgauguucgccgucggccuccuguuccgccggcugacgucccgcgaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgcgacgacacccugaccauccuccugaaggccacccugcucgccgucuccggcguguacccgcugagcauccccgccacgcuguucgugugguacuucuggcagaagaagaagcagcgguccgggguccucugggacacccccagcccgcccgagguggagcgcgccgugcuggacgacggcaucuaccggaucaugcagcgcggccugcuggggcggucccaggucggcguggggguguuccaggagaacgucuuccacaccauguggcacgugacccgcggcgcggugcucauguaccaggggaagcggcuggagcccagcugggccuccgucaagaaggaccugaucagcuacggcggcggguggcgccuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgguaccucccggccaucguccgcgaggccaucaagcggaagcugcgcacccugauccucgcccccacccgggugguggccuccgagauggcggaggcccugaagggcaugcccauccgcuaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaagagcggcaacgacaucgccaacugccugcgcaagaacgggaagcgggucauccagcucucccgcaagaccuucgacacggaguaccagaagaccaagaacaacgacugggacuacguggugaccaccgacaucagcgagaugggcgcgaacuuccgggccgaccgcgucaucgacccgcggcgcugccugaagcccgugauccugaaggacgggcccgagcgggugauccucgccggccccaugccggucacgguggccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccggcugcgcggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggucaugcugcacaacagcgagcagggcgggcgcgcguaccggcacgcccucgaggagcugcccgacaccaucgagacgcugaugcuccuggcccugaucgccgugcucaccggcggggugacccuguucuuccuguccggccgcgggcucggcaagaccagcaucggccugcugugcgucauggccuccagcgugcuccuguggauggcguccguggagccccacuggaucgccgccagcaucauccuggaguucuuccucaugguccugcugauccccgagccggaccggcagcgcacgccccaggacaaccagcucgccuacguggugaucgggcugcuguucaugauccucacggucgccgcgaacgagaugggccugcuggagaccaccaagaaggaccucgggaucggccacguggccguggagaaccaccaccacgccuccaugcuggacgucgaccugcaccccgccagcgccuggacccucuacgcgguggccacgaccaucaucaccccgaugaugcggcacaccaucgagaacacgaccgccaacaucucccugaccgccaucgccaaccaggcggccauccugauggggcucgacaagggcuggcccaucagcaagauggacaucggcgugccccugcuggcccucgggugcuacucccaggucaacccccugacccugacggccgcggugcucaugcugguggcccacuacgccaucaucggcccggggcugcaggccaaggccacccgcgaggcgcagaagcggaccgccgccggcaucaugaagaaccccaccgucgacgggaucguggccaucgaccucgaccccguggucuacgacgccaaguucgagaagcagcugggccagaucaugcugcucauccugugcacgagccagauccugcucaugcgcaccaccugggcgcugugcgaguccaucacccuggccacgggcccccucaccacccugugggaggggagcccgggcaaguucuggaacaccacgaucgccguguccauggccaacaucuuccgcgggagcuaccuggccggcgcgggccucgccuucagccugaugaagucccucgggggcgggcggcgcgggaccggggcccagggcgagacccucggcgagaaguggaagcggcagcugaaccagcugagcaaguccgaguucaacaccuacaagcgcagcgggaucauggagguggaccgguccgaggccaaggagggccucaagcgcggggagacgaccaagcacgcggucagccggggcaccgccaagcugcgcugguucguggagcggaaccuggugaagcccgaggggaaggucaucgaccugggcugcggccgcgggggcugguccuacuacugcgccgggcucaagaaggugaccgaggugaagggcuacacgaagggcgggcccggccacgaggagcccaucccgauggccaccuacggguggaaccuggucaagcugcacagcggcaaggacguguucuucaucccgcccgagaagugcgacacccuccugugcgacaucggggaguccagccccaacccgaccaucgaggagggccggacgcugcgcgugcucaagauggucgagcccuggcugcgggggaaccaguucugcaucaagauccugaaccccuacaugcccuccgugguggagacccucgagcagaugcagcgcaagcacggcggcaugcugguccggaacccgcugagccgcaacuccacccacgagauguacugggugagcugcgggaccggcaacaucguguccgccgucaacaugaccagccggaugcuccugaaccgcuucacgauggcgcaccggaagcccaccuacgagcgcgacguggaccugggggccggcacccgccacguggccgucgagcccgagguggccaaccucgacaucaucggccagcggaucgagaacaucaagcacgagcacaaguccaccuggcacuacgacgaggacaaccccuacaagacgugggccuaccacgggagcuacgaggugaagccguccggcagcgcgagcuccauggucaacgggguggucaagcugcugaccaagcccugggacgugauccccauggugacccagaccgccaugacggacaccacccccuucggccagcagcgcgucuucaaggagaagguggacacccggacgccgaaggccaagcgcgggaccgcccagaucauggaggugaccgcccgguggcucuggggcuuccugagccgcaacaagaagccccggaucugcacccgcgaggaguucacgcggaagguccgcuccaacgcggccaucggcgccguguucguggacgagaaccaguggaacagcgccaaggaggcggucgaggacgagcgguucugggaccuggugcaccgcgagcgggagcuccacaagcaggggaagugcgcgaccugcguguacaacaugaugggcaagcgcgagaagaagcugggggaguucggcaaggccaaggggucccgggccaucugguacauguggcugggcgcccgcuuccucgaguucgaggcgcugggcuucaugaacgaggaccacugguucagccgggagaacucccugagcggggucgagggcgaggggcuccacaagcugggcuacauccugcgcgacaucuccaagauccccgggggcaacauguacgccgacgacaccgccggcugggacacccggaucacggaggacgaccuccagaacgaggccaagaucaccgacaucauggagccggagcacgcccugcuggccaagagcaucuucaagcucaccuaccagaacaagguggugcgcguccagcggcccgccaagaacgggaccgugauggacgugaucucccgccgcgaccagcggggcagcgggcaggucggcacguacggccugaacaccuucaccaacauggaggcccagcugauccgccagauggaguccgaggggaucuucagccccuccgagcucgagacccccaaccuggccgagcgggugcuggacuggcucgagaaguacggcguggagcgccugaagcggauggccaucagcggggacgacugcgucgugaagccgaucgacgaccgcuucgcgacggcccugaccgcccucaacgacaugggcaaggugcggaaggacaucccccagugggagcccuccaagggguggaacgacuggcagcagguccccuucugcagccaccacuuccaccagcugaucaugaaggacggccgcgagaucguggugccgugccggaaccaggacgagcuggucggccgcgcccgggugagccagggggccggcuggucccuccgcgagaccgcgugccugggcaagagcuacgcccagauguggcagcugauguacuuccaccggcgcgaccuccggcuggccgccaacgcgaucugcuccgccgugcccgucgacugggugcccaccagccgcacgaccugguccauccacgcccaccaccaguggaugaccaccgaggacaugcugagcguguggaaccgggucuggaucgaggagaaccccuggauggaggacaagacgcacaucuccagcugggaggacgugccguaccucggcaagcgcgaggaccaguggugcgggucccugaucggccugaccgcccgggccaccugggcgaccaacauccagguggccaucaaccagguccgccgccucaucggcaacgagaacuaccuggacuacaugaccagcaugaagcgguucaagaacgaguccgaccccgagggggcccugugguga

SEQ ID NO: 8200 - RNA, 9879 nt, Artificial Sequence
  derived and/or modified CDS sequence (opt1) from DENV-1__FJ687432__SS-prME
agcgugaccaugcugcucaugcugaugcccaccgcccuggccuuccaccucaccacccggggcggggagccccacaugaucgugagcaagcaggagcggggcaagagccugcuguucaagaccuccaccggggugaacaugugcacccucaucgccauggaccugggcgagcugugcgaggacaccaugaccuacaagugcccccggaucaccgaggccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgcguggaagcagauccagaaggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgggacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcgcaagcucugcaucgaggcgaagaucuccaacaccacgaccgacagccggugcccgacccagggcgaggccacccugguggaggagcaggacgccaacuucgucugccgccggacguucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccggaccggccucgacuucaacgagaugguccugcugaccaugaaggagaaguccuggcucgugcacaagcagugguuccuggaccugccccuccccuggaccagcggggccagcacgucccaggagaccuggaaccgccaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccggcucaagauggacaagcugacccugaagggcaugagcuacgucaugugcacgggguccuucaagcucgagaaggagguggccgagacccagcacggcaccauccuggugcagaucaaguacgagggcaccgacgcgcccugcaagauccccuucagcacgcaggacgagaagggggucacccagaacggccgccugaucaccgccaacccgaucgugaccgacaaggagaagcccgugaacaucgaggccgagccgcccuucggggaguccuacaucgucaucggcgccggcgagaaggcgcugaagcucagcugguucaagaagggguccagcaucggcaagauguucgaggccacggcccgcggggcccgccggauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgcgagcucaagugcgggagcggcaucuucgucaccaacgaggugcacaccuggaccgagcaguacaaguuccaggccgacagcccgaagcggcuguccgcggccaucggcaaggccugggaggagggggugugcggcauccgcagcgccacccggcuggagaacaucauguggaagcagaucuccaacgagcucaaccacauccugcuggagaacgacaugaaguucacggucguggugggggacgucgccggcauccucgcgcaggggaagaagaugauccgcccccagcccauggaguacaaguacagcuggaaguccuggggcaaggccaagaucaucggcgccgacgugcagaacgccaccuucaucaucgacgggcccaacaccccggagugccccgacgaccagcgggcguggaacaucugggagguggaggacuacggcuucgggaucuucaccacgaacaucuggcugaagcugcgcgacagcuacacccaggucugcgaccaccggcucauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacgcuguggagcaacggcguccucgaguccgagaugaucauccccaagaucuacgggggcccgaucagccagcacaacuaccggcccggguacuucacccagaccgccggccccuggcaccuggggaagcuggagcucgacuucgaccugugcgagggcaccacggugguggucgacgagcacugcggcaaccgcgggccgucccugcggaccaccaccgugacgggcaagaucauccacgaguggugcugccgcagcugcacccugccgccccuccgguuccgcggggaggacggcugcugguacgggauggagauccggcccgugaaggagaaggaggagaaccuggucaaguccauggugagcgccggcagcggcgagguggacuccuucagccucgggcugcugugcaucuccaucaugaucgaggaggucaugcgcagccgguggucccgcaagaugcucaugaccggcacccuggccguguucuuccugcucaucauggggcagcugacguggaacgaccugauccggcucugcaucauggugggcgcgaacgccagcgaccgcauggggaugggcaccaccuaccuggcccugauggccaccuucaagaugcgcccgauguucgccgucggccuccuguuccggcgccugacgucccgggaggugcuccugcugaccaucgggcucagccugguggcguccgucgagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgauggugcugagcaucgucucccucuucccccugugccugagcacgaccucccagaagaccaccuggcuccccgugcugcugggcagccucgggugcaagccgcugacgauguuccugaucgccgagaacaagaucuggggccgcaaguccuggccccucaacgaggggaucauggccgugggcaucgucagcauccugcugagcucccuccugaagaacgacgugccccuggccgggccccucaucgccggcggcaugcugaucgcgugcuacgugaucagcggguccagcgccgaccugucccucgagaaggccgccgaggucagcugggaggaggaggccgagcacuccggcgcgagccacaacauccugguggaggugcaggacgacgggaccaugaagaucaaggacgaggagcgggacgacacccugaccauccuccugaaggccacccugcucgccgucuccggcguguacccgcugagcauccccgccacgcuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacccggggcgcggugcucauguaccaggggaagcgccuggagcccagcugggccuccgucaagaaggaccugaucagcuacggcggcggguggcggcuccagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccuguacggcaacgggguggucaccaccagcggcaccuacgugagcgccaucgcccaggccaaggcgucccaggaggggccgcuccccgagaucgaggacgagguguuccggaagcgcaaccugacgaucauggaccugcaccccggcagcgggaagacccggcgcuaccucccggccaucguccgggaggccaucaagcgcaagcugcggacccugauccucgcccccacccgcgugguggccuccgagauggcggaggcccugaagggcaugcccauccgcuaccagacgaccgccgucaagagcgagcacaccggcaaggagaucguggaccugaugugccacgccaccuucacgaugcggcuccugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccugaaggacgggcccgagcgcgugauccucgccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgccgcgaucgacggggaguaccgccugcgcggcgaggcccggaagaccuucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggacgaaggagggggagcggaagaagcugcgcccccgguggcuggacgcccgcaccuacuccgacccccucgcccugcgggaguucaaggaguucgcggccggccgccggagcguguccggggaccugauccucgagaucggcaagcugccgcagcaccugacccagcgcgcccagaacgcccucgacaaccuggucaugcugcacaacagcgagcagggcgggcgggcguaccgccacgcccucgaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggagaaccaccaccacgccuccaugcuggacgucgaccugcaccccgccagcgccuggacccucuacgcgguggccacgaccaucaucaccccgaugaugcgccacaccaucgagaacacgaccgccaacaucucccugaccgccaucgccaaccaggcggccauccugauggggcucgacaagggcuggcccaucagcaagauggacaucggcgugccccugcuggcccucgggugcuacucccaggucaacccccugacccugacggccgcggugcucaugcugguggcccacuacgccaucaucggcccggggcugcaggccaaggccacccgggaggcgcagaagcgcaccgccgccggcaucaugaagaaccccaccgucgacgggaucguggccaucgaccucgaccccguggucuacgacgccaaguucgagaagcagcugggccagaucaugcugcucauccugugcacgagccagauccugcucaugcgcaccaccugggcgcugugcgaguccaucacccuggccacgggcccccucaccacccugugggaggggagcccgggcaaguucuggaacaccacgaucgccguguccauggccaacaucuuccgggggagcuaccuggccggcgcgggccucgccuucagccugaugaagucccucgggggcgggcgccgggggaccggggcccagggcgagacccucggcgagaaguggaagcgccagcugaaccagcugagcaaguccgaguucaacaccuacaagcggagcgggaucauggagguggaccgcuccgaggccaaggagggccucaagcgcggggagacgaccaagcacgcggucagccgcggcaccgccaagcugcggugguucguggagcgcaaccuggugaagcccgaggggaaggucaucgaccugggcugcggccgcggcgggugguccuacuacugcgccgggcucaagaaggugaccgaggugaagggguacacgaagggcggccccggccacgaggagcccaucccgauggccaccuacggguggaaccuggucaagcugcacagcggcaaggacguguucuucaucccgcccgagaagugcgacacccuccugugcgacaucggggaguccagccccaacccgaccaucgaggagggccgcacgcugcgggugcucaagauggucgagcccuggcugcgcgggaaccaguucugcaucaagauccugaaccccuacaugcccuccgugguggagacccucgagcagaugcagcggaagcacggcggcaugcugguccgcaacccgcugagccggaacuccacccacgagauguacugggugagcugcgggaccggcaacaucguguccgccgucaacaugaccagccgcaugcuccugaaccgguucacgauggcgcaccgcaagcccaccuacgagcgcgacguggaccugggggccggcacccggcacguggccgucgagcccgagguggccaaccucgacaucaucggccagcgcaucgagaacaucaagcacgagcacaaguccaccuggcacuacgacgaggacaaccccuacaagacgugggccuaccacgggagcuacgaggugaagccguccggcagcgcgagcuccauggucaacgggguggucaagcugcugaccaagcccugggacgugauccccauggugacccagaccgccaugacggacaccacccccuucggccagcagcgggucuucaaggagaagguggacacccgcacgccgaaggccaagcgggggaccgcccagaucauggaggugaccgcccgcuggcucuggggcuuccugagccggaacaagaagccccgcaucugcacccgggaggaguucacgcgcaagguccgguccaacgcggccaucggcgccguguucguggacgagaaccaguggaacagcgccaaggaggcggucgaggacgagcgcuucugggaccuggugcaccgggagcgcgagcuccacaagcaggggaagugcgcgaccugcguguacaacaugaugggcaagcgggagaagaagcugggggaguucggcaaggccaaggggucccgcgccaucugguacauguggcugggcgcccgguuccucgaguucgaggcgcugggcuucaugaacgaggaccacugguucagccgcgagaacucccugagcggggucgagggcgaggggcuccacaagcugggcuacauccugcgggacaucuccaagauccccgggggcaacauguacgccgacgacaccgccggcugggacacccgcaucacggaggacgaccuccagaacgaggccaagaucaccgacaucauggagccggagcacgcccugcuggccaagagcaucuucaagcucaccuaccagaacaagguggugcggguccagcgccccgccaagaacgggaccgugauggacgugaucucccgccgggaccagcgcggcagcgggcaggucggcacguacggccugaacaccuucaccaacauggaggcccagcugauccggcagauggaguccgaggggaucuucagccccuccgagcucgagacccccaaccuggccgagcgcgugcuggacuggcucgagaaguacggcguggagcggcugaagcgcauggccaucagcggggacgacugcgucgugaagccgaucgacgaccgguucgcgacggcccugaccgcccucaacgacaugggcaaggugcgcaaggacaucccccagugggagcccuccaagggguggaacgacuggcagcagguccccuucugcagccaccacuuccaccagcugaucaugaaggacggccgggagaucguggugccgugccgcaaccaggacgagcuggucggccgggcccgcgugagccagggggccggcuggucccuccgggagaccgcgugccugggcaagagcuacgcccagauguggcagcugauguacuuccaccgccgggaccuccgccuggccgccaacgcgaucugcuccgccgugcccgucgacugggugcccaccagccggacgaccugguccauccacgcccaccaccaguggaugaccaccgaggacaugcugagcguguggaaccgcgucuggaucgaggagaaccccuggauggaggacaagacgcacaucuccagcugggaggacgugccguaccucggcaagcgggaggaccaguggugcgggucccugaucggccugaccgcccgcgccaccugggcgaccaacauccagguggccaucaaccagguccgccggcucaucggcaacgagaacuaccuggacuacaugaccagcaugaagcgcuucaagaacgaguccgaccccgagggggcccugugguga

SEQ ID NO: 8201 - RNA, 9879 nt, Artificial Sequence
  derived and/or modified CDS sequence (opt1) from DENV-1__JQ922547__SS-prME
agcgugaccaugcugcucaugcugcugcccaccgcccucgccuuccaccugaccacccggggcggggagccgcacaugaucgugagcaagcaggagcggggcaagagccuccuguucaagaccagcgcgggggugaacaugugcacccugaucgccauggaccugggggagcucugcgaggacaccaugaccuacaagugcccccggaucaccgaggccgagcccgacgacguggacugcuggugcaacgccaccgacacgugggugaccuacgggaccugcagccagaccggggagcaccggcgcgacaagcgguccguggcccuggcgccccacguggggcuggggcucgagacgcgcgccgagaccuggaugagcagcgagggcgccuggaagcagauccagaaggucgagaccugggcccugcggcaccccggguucaccgugaucgcgcuguuccucgcccacgccaucggcacgagcaucacccagaaggggaucaucuucauccugcugaugcucgugacccccuccauggccaugcgcugcgucggcaucggcaaccgggacuucguggaggggcugagcggcgcccccuggguggacgucgugcuggagcacggguccugcgugaccacgauggcgaagaacaagcccacccucgacaucgagcugcugaagaccgaggucaccaacccggccgugcuccgcaagcugugcaucgaggccaagaucagcaacacgaccaccgacucccggugccccacccagggcgaggccacgcugguggaggagcaggacgccaacugcgucugccgccggaccuucguggaccgcggcugggggaacggcugcggccuguucggcaaggggagccugaucacgugcgcgaaguucaagugcgugaccaagcuggagggcaagaucguccaguacgagaaccucaaguacuccgugaucgugacgguccacaccggcgaccagcaccagguggggaacgagaccaccacgcacggcaccaccgccaccaucacgccccaggcccccacgagcgagauccagcugaccgacuacggggcccugacccucgacugcuccccgcggaccggccuggacuucaacgagaugguccugcucacgaugaaggagaaguccuggcuggugcacaagcagugguuccuggaccucccccugcccuggaccuccggggccagcaccagccaggagaccuggaaccgccaggaccugcucgugacguucaagaccgcgcacgccaagaagcaggaggucguggugcugggcucccaggagggcgccaugcacaccgcccugaccggggccacggagauccagaccagcggcaccaccacgaucuucgcggggcaccucaagugccggcugaagauggacaagcugacccucaagggcauguccuacgucaugugcaccgggagcuucaagcuggagaaggagguggccgagacccagcacggcacggugcugguccaggugaaguacgagggcaccgacgcccccugcaagaucccguucuccacccaggacgagaagggggccacccagaacggccgccugaucacggcgaaccccaucgugaccgacaaggagaagcccgucaacaucgaggccgagcccccguucggggagagcuacaucguggugggcgccggcgagaaggcccucaagcuguccugguucaagaaggggagcuccaucggcaagaugcuggaggccaccgcgcgcggggcccgccggauggccauccucggcgacaccgccugggacuucgggagcaucggcggcgucuucacguccauggggaagcuggugcaccagguguucggcaccgccuacgggguccuguucagcggcguguccuggaccaugaagaucgggaucggcauccuccugaccuggcugggccucaacagccgcaacacgucccugagcaugaugugcaucgcgguggggauggucacccuguaccucggcgugauggugcaggccgacuccgggugcgucaucaacuggaagggccgcgagcugcugugcgggaccggcaucuucgugaccaacgaggugcacacguggaccgaccccuacaaguuccaggccgaccccagcaaccggcucucccccaucaucggcaaggccugcgucauccgcgugugcgggauccggagcgccacccgccuggagaacaucauguggaagcagaucagcaacgagcugaaccacauccuccuggagaacgacaugaaguucaccguggucgugggcgacguguccgggauccuggcgcagggcgagaagaugauccggccgcagcccauggagcacaaguacagcuggaaguccugggggaaggccaagaucaucggcgccgacguccagaacaccacguucaucaucgacggccccaacacccccgagugcccggacaaccagcgcgccuggaacaucugggagguggaggacuacggguucggcaucuucaccaccaacaucuggcucaagcugcgggacagcuacacccaggugugcgaccaccgccugauguccgcggccaucaaggacagcaaggccguccacgccgacaugggguacuggaucgaguccgagaagaacgagacguggaagcucgcccgggcgagcuucaucgaggugaagaccugcaccuggcccaagucccacacgcuguggagcaacggcgugcuggaguccgagaugaucauccccaagaucuacggcgggccgaucagccagcacaacuaccgccccggcuacuucacccagaccgccgggcccuggcaccucggcaagcuggagcuggacuucgacuucugcgaggggaccacggucgugguggacgagcacugcggcaaccggggccccucccuccgcaccaccaccgucacggggaagaucauccacgaguggugcugccggagcugcacccugccgccccugcgcuucaagggcgaggacgggugcugguacggcauggagauccggcccgugaaggacaaggaggagaaccucgugaaguccauggucagcgccggguccggcgagguggacagcuucagccugggccugcucugcaucuccaucaugaucgaggaggugaugcgcagccggugguccaagaagaugcugauggucgggacccuggccguguuccuccugcugaucaugggccagcucaccuggagcgaccugauccgccugugcaucauggugggggccaacgcguccgaccggaugggcauggggacgaccuaccucgcccugauggccaccuucaagaugcgccccauguucgccgucggccuccucuucccgaagcugaccagccgcgaggugcugcuccugacgaucggccugucccucgucgccagcguggagcugcccuccagccuggaggagcucggggacggccuggcgaaggggaucaugaugcugaagcuccugaccgacuuccagucccaccagcugugggccacccuccugagccugaccuucaucaagacgaccuucucccuccacuacgccuggaagaccauggccauggugcugagcaucgucucccuguucccccucugccugagcaccacgucccagaagaccaccuggcugcccgugcuccugggcagccugggcugcaagccgcuccccauguuccugaucaccgagaacaagaucugggggcggaaguccuggccccugaacgagggcaucauggcgguggggaucgucagcauccuccugagcucccugcucaagaacgacgugccccuggccggcccgcugaucgccgggggcaugcucguggccugcuacgucaucagcggcuccagcgccgaccugucccuggagaaggcggccgaggugagcugggaggaggaggccgagcacuccggggccagccacaacauccucguggagguccaggacgacggcacgcgcaagaucaaggacgaggagcgggacgacacccugaccauccugcucaaggccacccugcuggcgguguccgggguguaccccaugagcauccccgccacccucuucgucugguacuucuggcagaagaagaaccagcgcuccggcguggggcugaucacgcccagcccgcccgagguggagcgggccguccuggacgacggcaucuaccgcauccugcagcggggccuccuggggcgcucccaggugggcgugggggucuuccaggagggcguguuccacaccauguggcacgugacccgcggggccguccugauguaccagggcaagcgccucgagcccagcugggccuccgugaagaaggaccugaucagcuacggcgggggcuggcgguuccagggguccuggaacaccggcgaggaggugcaggucaucgcgguggagcccgggcgcaacccgaagaacgugcagacggcccccggcaccuucaagacccccgagggcgaggucggggccaucccgcuggacuucaagcccggcaccagcgggucccccaucgugaaccgggagggcaagaucgugggccucuacgggaacggcgucgugacgaccagcgggaccuacgugagcgccaucgcccgcgcgaaggccucccaggagggcccccugccggagaucgaggacgaggucuuccggaagcgcaaccugaccaucauggaccuccaccccgggagcggcaagacgcggcgcuaccugcccgccaucgugcgggaggccaucaagcgcaagcugcggacccucauccuggcgcccacccgcguggucgccuccgagauggccgaggcccugaagggcgugccgauccgcuaccagaccacggccgucaagagcgagcacaccgggaaggagaucgucgaccucaugugccacgcgaccuucaccaugcggcugcugucccccgugcgcgugcccaacuacaacaugaucaucauggacgaggcccacuucacggaccccgccagcaucgccgcccggggcuacaucuccacccgcgucgggaugggcgaggcggccgccaucuucaugaccgccaccccgacggggagcguggaggccuucccccaguccaacgcgaucauccaggacgaggagcgggacauccccgagcgcagcuggaacuccggcuacgacuggaucaccgacuuccccggcaagaccgugugguucgucccgagcaucaaguccgggaacgacaucgccaacugccucaagaagaacggcaagcgggugauccagcugagccgcaagaccuucgacacggaguaccagaagaccaagaacaacgacugggacuacguggucaccaccgacaucuccgagaugggggccaacuuccgggccgaccgcgugaucgacccccggcgcugccugaagcccgucauccucaaggacggccccgagcgggugauccuggcggggccgaugcccgugacggucgccagcgccgcccagcgccggggccgcaucggccggaaccagaacaaggagggggaccaguacaucuacaugggccagcccuccaacaacgacgaggaccacgcccacuggaccgaggcgaagaugcugcucgacaacaucaacacccccgaggggaucaucccggcccuguucgagcccgagcgcgagaaguccgccgccaucgacggcgaguaccggcugcgcggggaggcccgcaagaccuucguggagcucaugcggcgcggcgaccugcccguguggcuguccuacaaggucgcgagcgagggcuuccaguacagcgaccggcgcuggugcuucgacggggagcggaacaaccaggugcucgaggagaacaaggacguggagaucuggacgaaggagggcgagcgcaagaagcugcggaccugcuggcuggacgcccgcaccuacuccgacccccucgcccugcgggaguucaaggaguucgccgccgggcgccggagcgucuccggcgaccugauccucgagaucggcaagcugccgcagcaccugacccagaaggcgcagaaggcccucgacaaccuggugaugcugcacaacagcgagcagggcgggaaggccuaccgccacgccauggaggagcuccccgacacgaucgagacccugaugcugcucgcgcugaucgccgugcugaccgggggcgucacccucuucuuccuguccgggcggggccugggcaagaccagcaucgggcuccugugcgugauggccuccagcgugcugcucuggauggccuccgucgagccccacuggaucgccgcgagcaucauccuggaguucuuccugauggugcuccugaucccggagcccgaccgccagcggacgccccaggacaaccagcuggccuacguggucaucggccuccuguucaugauccugaccguggccgccaacgagauggggcuccuggagaccaccaagaaggaccugggcaucgggcacguggccgcggagaaccaccaccacgccacgaugcucgacgucgaccugcgccccgccuccgccuggacccuguacgccguggcgaccaccaucaucacgccgaugaugcggcacaccaucgagaacaccaccgccaacaucagccucacggccaucgccaaccaggccgcgauccugaugggccuggacaagggcuggcccaucuccaagauggacaucggggugccccuccuggcccugggcugcuacagccaggucaacccccucacccugaccgccgccgugcugaugcucguggcgcacuacgccaucaucgggccgggccugcaggccaaggccacccgcgaggcccagaagcggacggcggccgggaucaugaagaaccccaccgucgacggcaucguggccaucgaccuggaccccguggucuacgacgccaaguucgagaagcagcucggccagaucaugcugcugauccucugcaccucccagauccugcugaugcgcaccacgugggcccucugcgagagcaucacccuggcgaccgggccccugaccacgcucugggagggcuccccggggcgguucuggaacaccaccaucgccgugagcauggccaacaucuuccgcggcuccuaccuggccggcgccgggcuggcguucagccucaugaagucccugggcgggggccgccgggggaccggcgcccagggcgagacgcugggggagaaguggaagcgccagcucaaccagcuguccaagagcgaguucaacaccuacaagcgguccggcaucauggagguggaccgcagcgaggccaaggaggggcugaagcggggcgagaccaccaagcacgccgucucccgcgggacggcgaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagcccaucccgauggccaccuacggcuggaaccucgucaagcugcacuccgggaaggacguguucuucaucccgcccgagaagugcgacacgcugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccggaacagcacccacgagauguacuggguguccugcggcacggggaacaucgugagcgccgucaacaugaccucccgcaugcugcucaaccgguucaccauggcccaccgcaagcccaccuacgagcgggacguggaccugggcgcgggcacgcgccacguggccgucgagcccgagguggccaaccuggacaucaucgggcagcgcaucgagaacaucaagaacgagcacaagagcaccuggcacuacgacgaggacaaccccuacaagaccugggccuaccacggcuccuacgaggucaagccgagcggguccgccagcagcauggugaacggcgugguccggcuccugaccaagcccugggacgugauccccauggugacgcagaucgcgaugaccgacaccaccccguucgggcagcagcgcgucuucaaggagaagguggacacgcggacccccaaggccaagcgcggcaccgcccagaucauggaggugaccgcccgguggcuguggggcuuccucucccgcaacaagaagccccggaucugcacgcgcgaggaguucacccggaagguccgcagcaacgccgcgaucggggccguguucguggacgagaaccaguggaacuccgccaaggaggccgucgaggacgagcgguucugggaccuggugcaccgcgagcgggagcugcacaagcagggcaagugcgcgaccugcguguacaacaagauggggaagcgcgagaagaagcucggcgaguucgggaaggccaagggcagccgggccaucugguacauguggcugggcgcccgcuuccuggaguucgaggcccucggguucaugaacgaggaccacugguucucccgggagaacagccuguccggcgucgagggggagggccugcacaagcucggguacauccugcgcgacaucagccggauccccggcggcaacauguacgcggacgacaccgccgggugggacacgcgcaucaccgaggacgaccugcagaacgaggccaagaucaccgacaucauggagccggagcacgcccuccuggccaccuccaucuucaagcugacguaccagaacaagguggugcggguccagcgccccgcgaagaacggcaccgugauggacgccaucagccgccgggaccagcgcggguccggccaggugggcaccuacgggcucaacaccuuccugcacaaggaggcccagcugauccggcagauggaguucgagggcaucuuccuccccagcgagcuggagacgcccaaccuggccgggcgcguccucgacuggcuggagcaguacggcguggagcggcugaagcgcauggccaucuccggggacgacugcguggucaagccgaucgacgaccgguucgcgaccgcccucaccgcccugaacgacaugggcaaggugcgcaaggacaucccccagugggagcccagcaagggcuggggcgacuggcagcagguccccuucugcucccaccacuuccaccagcugaucaugaaggacguccgggagaucguggugccgugccgcaaccaggacgagcucgucggccgggcccgcgugagccagggggccggcuggucccugcgggagaccgcgugccugggcaagagcuacgcccagauguggcagcucauguacuuccaccgccgggaccugcgccuggccgccaacgcgaucugcagcgccgugcccgucgacugggugcccacgucccggaccaccuggagcauccacgcccaccaccaguggaugaccacggaggacaugcucuccguguggaaccgcgucuggaucgaggagaaccccuggauggaggacaagacccacgugagcuccugggaggacgugccguaccugggcaagcgggaggaccaguggugcggcagccugaucgggcucaccgcccgcgccaccugggcgaccaacauccaggucgccaucaaccaggugcgccggcugaucggcaacgagaacuaccuggacuacaugacguccaugaagcgcuucaagaacgagagcgaccccgagggggcccucugguga

SEQ ID NO: 8202 - RNA, 9879 nt, Artificial Sequence
  derived and/or modified CDS sequence (opt1) from DENV-1__EU482567__SS-prME
agcgugaccaugcugcucaugcugcugcccaccgcccucgccuuccaccugaccacccggggcggggagccgcacaugaucgugagcaagcaggagcggggcaagagccuccuguucaagaccagcgcggggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccgucgcccuggcgccccacgugggccuggggcucgagacgcggaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugauccucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugccccacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcgccgggaagcuggugcaccagguguucggcgccgccuacgggguccuguucuccggcgugagcuggaccaugaagaucgggaucggcauccuccugaccuggcugggccucaacucccgcagcacgucccugagcaugaccugcaucgccguggggauggucacccuguaccucggcguggugguccaggcggacuccgggugcgugaucaacuggaagggccgcgagcugaagugcgggagcggcaucuucgugaccaacgagguccacacguggaccgagcaguacaaguuccaggccgacagcccgaagcggcuguccgccgccaucggcaaggccugggaggagggggugugcggcauccgcagcgcgacccggcucgagaacaucauguggaagcagaucuccaacgagcugaaccacauccugcucgagaacgacaugaaguucaccguggucgugggggacgccaacggcauccuggcccaggggaagaagaugauccgcccccagcccauggagcaccgguacagcuggaaguccuggggcaaggccaagaucaucggcgcggacauccagaacgccaccuucaucaucgacgggcccgacacgccggagugccccgacgaccagcgcgccuggaacaucugggagguggaggacuacggcuucgggaucuucaccaccaacaucuggcugaagcuccgggacagcuacacccagaugugcgaccaccgccugauguccgccgccaucaaggacagcaaggcgguccacgccgacaugggcuacuggaucgaguccgagaagaacgagacguggaagcuggcccgggccagcuucaucgaggugaagaccugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgucgugguggacgagcacugcggcaaccgggggccgucccuccgcaccacgaccgucaccggcaagaucauccacgaguggugcugccggagcugcacccugccgccccugcgcuuccgcggggaggacggcugcugguacgggauggagauccgccccgugaaggagaaggaggagaaccucgugcgguccauggucagcgcgggcagcggcgagguggacuccuucagccuggggauccugugcguguccaucaugaucgaggaggucaugcgcagccgguggucccgcaagaugcucaugacgggcacccuggccguguuccugcuccugaucauggggcagcugaccuggaaggaccucauccgccugugcaucauggugggcgccaacgccagcgaccggauggggaugggcaccacguaccuggcccucauggcgaccuucaagaugcgcccgauguucgccgucgggcugcuguuccggcgccucaccucccgggaggugcugcugcucaccaucgggcugagccugguggccuccgucgagcuccccaacagccuggaggagcugggcgacgggcucgccaugggcaucaugaugcugaagcugcucacggaguuccagccccaccagcuguggaccacccugcucucccugaccuucaucaacacgacccugagccucgacuacgcguggcgcaccauggccauggugcuguccaucaucagccuguucccccucugccuguccaccacgagccagaagaccaccuggcugccgguccuccugggcuccuucgggugcaagccccugaccauguuccucaucacggagaacaagaucuggggccgcaagagcuggccccugaacgaggggaucauggccaucggcaucguguccauccugcucagcagccugcugaagaacgacgugccccucgccgggccgcugaucgccggcggcaugcugaucgcgugcuacgucaucuccgggagcuccgccgaccucagccuggagaaggccgccgagguguccugggaggaggaggccgagcacagcggcaccucccacaacauccugguggagguccaggacgacgggaccaugaagaucaaggacgaggagcgcgacgacacccucaccauccugcugaaggcgacgcuccuggccgugagcggcguguaccccauguccauccccgccacccuguucgucugguacuucuggcagaagaagaagcagcggagcggggugcucugggacacccccuccccgcccgagguggagcgcgccguccuggacgacggcaucuaccggauccugcagcgcggccugcucgggcggagccaggugggcgugggggucuuccaggacggcguguuccacaccauguggcacgugacgcgcggggccguccugauguaccagggcaagcggcuggagcccuccugggcgagcgugaagaaggaccucaucuccuacggcgggggcuggcgcuuccaggggagcuggaacaccggcgaggaggugcaggucaucgccguggagcccgggaagaacccgaagaacgugcagaccacccccggcacguucaagacccccgagggcgaggucggggccaucgcccuggacuucaagcccggcaccuccgggagcccgaucgugaaccgggagggcaagaucgugggccuguacgggaacggcgucgugaccacguccgggaccuacgugagcgccaucgcgcaggccaagaccagccaggagggcccccuccccgagaucgaggacgaggucuucaagaagcgcaaccugaccaucauggaccugcacccgggguccggcaagacgcggcgcuaccuccccgccaucgugcgggaggccaucaagcgcaagcugcgcacccugauccucgcgcccacccggguggucgccagcgagauggccgaggcccugaagggcaugcccauccgcuaccagaccacggccgugaaguccgagcacaccgggcgggagaucguggaccugaugugccacgcgaccuucaccaugcgccuccugagcccgguccgggugcccaacuacaacaugaucaucauggacgaggcccacuucacggaccccgccuccaucgccgcccgcggcuacaucagcacccggguggggaugggcgaggcggccgccaucuucaugaccgccacgccgcccggguccgucgaggccuucccccagagcaacgcggugauccaggacgaggagcgcgacauccccgagcgguccuggaacagcggcuacgacuggaucacggacuuccccggcaagaccgugugguucguccccuccaucaagagcgggaacgacaucgccaacugccugcgcaagaacggcaagcgggugauccagcucucccgcaagaccuucgacaccgaguaccagaagacgaagaacaacgacugggacuacguggucaccaccgacaucagcgagaugggggccaacuuccgggccgaccgcgugaucgacccccggcgcugccugaagcccgugauccugaaggacggccccgagcgggucauccucgcggggccgaugcccgugaccguggccuccgccgcccagcgccggggccgcaucggccgcaaccagaacaaggagggggaccaguacgucuacaugggccagccccugaacaacgacgaggaccacgcccacuggacggaggcgaagaugcugcucgacaacaucaacacccccgaggggaucaucccggcccuguucgagcccgagcgggagaaguccgccgccaucgacggcgaguaccgccugcgcggggaggcccgcaagaccuucguggagcucaugcggcgcggcgaccugcccgucuggcuguccuacaagguggcgagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggacguacagcgacccgcucgcccugcgcgaguucaaggaguucgccgccgggcggcgcagcguguccggcgaccugauccucgagaucggcaagcugccccagcaccugacccuccgggcgcagaacgcccuggacaaccuggugaugcuccacaacagcgagcagggcgggaaggccuaccgccacgccauggaggagcugcccgacaccaucgagacccugaugcuccuggcgcugaucgccguccucaccgggggcgugacgcuguucuuccuguccgggaagggccucggcaagaccagcaucgggcugcugugcgugauggccuccagcgcccuccuguggauggccaacgucgagccccacuggaucgcggccuccaucauccuggaguucuuccucauggugcugcugaucccggagcccgaccggcagcgcacgccccaggacaaccagcucgccuacguggucaucggccugcuguucaugauccucaccguggccgccaacgagauggggcugcuggagacgaccaagaaggaccucggcaucgggcacguggcggccgagaaccaccaccacgccaccaugcuggacgucgaccugcggccggccagcgccuggacccucuacgcgguggccacgaccgugaucacccccaugaugcgccacaccaucgagaacacgaccgccaacaucucccugaccgccaucgccaaccaggcggccauccugaugggccucgacaagggcuggcccaucagcaagauggacaucggggucccccugcuggcccucggcugcuacucccaggugaacccgcugacccugacggccgcggugcucaugcuggucgcccacuacgccaucaucgggcccggccugcaggccaaggccacccgcgaggcgcagaagcggaccgccgccgggaucaugaagaaccccaccguggacggcaucguggccaucgaccucgaccccgucguguacgacgccaaguucgagaagcagcugggccagaucaugcugcucauccugugcacgagccagauccugcucaugcgcaccaccugggcgcugugcgaguccaucacccuggccacggggccgcucaccacccugugggagggcagccccgggaaguucuggaacaccacgaucgccguguccauggccaacaucuuccggggcagcuaccuggccggcgcggggcucgccuucucccugaugaagucccugggcgggggccgccgggggaccggcgcccagggcgagacccucggggagaaguggaagcgccagcugaaccagcuguccaagagcgaguucaacaccuacaagcggagcggcaucauggaggucgaccgcuccgaggcccgggaggggcucaagcgcggcgagacgaccaagcacgcggugagccgggggaccgccaagcugcgcugguucguggagcggaaccuggucaagcccgagggcaaggugaucgaccugggcugcgggcgcggcgggugguccuacuacugcgccggccucaagaaggugaccgaggucaagggguacacgaagggcggccccgggcacgaggagccgauccccauggccaccuacggcuggaaccuggugaagcuguacagcgggaaggacguguucuucaucccgcccgagaagugcgacacccuccugugcgacaucggcgaguccagcccgaaccccaccaucgaggaggggcggacccugcgcguccucaagaugguggagcccuggcugcggggcaaccaguucugcaucaagauccugaaccccuacaugccguccguggucgagacgcucgagcagaugcagcgcaagcacggcgggaugcuggugcggaacccccugagccgcaacuccacccacgagauguacugggugagcugcggcaccgggaacaucgucuccgccgugaacaugaccagccgcaugcuccugaaccgguucacgauggcgcaccgcaagcccaccuacgagcgggacguggaccugggcgccggcacccgccacgucgccguggagcccgagguggccaaccucgacaucaucgggcagcggaucgagaacaucaagaacgagcacaaguccaccuggcacuacgacgaggacaacccguacaagacgugggccuaccacggcagcuacgaggucaagcccuccgggagcgcguccagcauggugaacggcgugguccgccugcugaccaagcccugggacgugauccccauggucacccagaucgccaugaccgacacgaccccguucgggcagcagcggguguucaaggagaagguggacacccgcacgccccgggccaagcgcggcacggcccagaucauggaggucaccgccaaguggcucuggggcuuccugucccggaacaagaagccccgcaucugcacccgggaggaguucacccgcaaggugcggagcaacgcggccaucggggccguguucgucgacgagaaccaguggaacagcgccaaggaggcgguggaggacgagcgcuucuggaaccuggugcaccgggagcgcgagcuccacaagcagggcaagugcgccacgugcgucuacaacaugauggggaagcgggagaagaagcugggcgaguucgggaaggccaagggcucccgcgccaucugguacauguggcugggcgcccgguuccucgaguucgaggcgcugggguucaugaacgaggaccacugguucagccgcgagaacuccuucagcggcguggagggggagggccugcacaagcucggguacauccugcgcgacaucuccaagaucccgggcggcaacauguacgccgacgacaccgccgggugggacacccggaucaccgaggacgaccugcagaacgaggccaagaucacggacaucauggagcccgagcacgcccuccuggcgaccagcaucuucaagcugaccuaccagaacaaggugguccgcgugcagcggcccgccaagaacggcaccgugauggacgucaucucccgccgggaccagcgcgggagcggccaggugggcacguacgggcucaacaccuucaccaacauggaggugcagcugauccggcagauggaguccgagggcaucuuccugcccagcgagcucgagaccccgaaccuggccgagcgcguccuggacuggcucgagaagcacgggacggagcggcugaagcgcauggccaucuccggcgacgacugcguggugaagcccgucgacgagcgguucgccaccgcgcugaucgcccucaacgacauggggaaggugcgcaaggacaucccccagugggagcccagcaagggcuggaacgacuggcagcaggucccguucugcucccaccacuuccaccagcugaucaugaaggacggccgggagaucgucgugcccugccgcaaccaggacgagcugguggggcgggcccgcgucagccagggcgccggguggucccuccgggagaccgccugccugggcaagagcuacgcgcagauguggcagcugauguacuuccaccgccgggaccuccgccuggccgccaacgccaucugcuccgcggugcccguggacuggguccccaccagccgcacgaccuggagcauccacgcccaccaccaguggaugaccaccgaggacaugcuguccguguggaaccggguguggaucgaggagaacccguggauggaggacaagacccacgucagcuccugggaggaggugcccuaccucgggaagcgcgaggaccaguggugcggcagccugaucggccugacggcccgggccaccugggccaccaacauccagguggcgaucaaccagguccgccggcucaucgggaacgagaacuaccuggacuacaugaccuccaugaagcgcuucaagaacgagagcgaccccgagggcgcccugugguga

SEQ ID NO: 8203 - RNA, 9879 nt, Artificial Sequence
  derived and/or modified CDS sequence (opt1) from DENV-1__FJ390378__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggccguguuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccgucgggcugcuguuccggcgccucaccagccgggaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcgcaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgcgacgacacccucaccauccugcugaaggccacgcuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacaccauguggcacgucacgcgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacccccggcacguucaagacccccgagggcgaggugggggcgaucgcccuggacuucaagcccggcaccagcggguccccgaucgugaaccgggagggcaagaucgucggccuguacgggaacggcguggugaccacgagcgggaccuacgucagcgccaucgcccaggccaagaccucccaggagggcccccuccccgagaucgaggaggagguguucaagaagcgcaaccugaccaucauggaccugcacccggggagcggcaagacgcggcgcuaccuccccgcgaucgugcgggaggccaucaagcgcaagcugcgcacccugauccucgcccccacccgggucguggccuccgagauggcggaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcccacuucacggaccccgcgagcaucgccgcccgcggcuacaucuccacccgggucgggaugggcgaggccgccgcgaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgcggaacaacgacugggacuacgucgugaccaccgacaucuccgagaugggggcgaacuuccgcgccgaccgggugaucgacccccgccggugccugaagcccgucauccugaaggacggccccgagcgcgugauccucgccgggccgaugcccgugaccgucgccagcgcggcccagcggcgcggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcacguacagcgacccgcucgcgcugcgggaguucaaggaguucgccgccgggcgccgguccgugagcggcgaccugauccucgagaucggcaagcugccccagcaccugacccuccgcgcccagaacgcccuggacaaccuggucaugcuccacaacuccgagcagggcgggaaggcguaccggcacgccauggaggagcugcccgacaccaucgagacccugaugcuccuggcccugaucgccgugcucaccgggggcgugacgcuguucuuccugagcgggaagggccucggcaagaccuccaucgggcugcugugcgucauggcgagcuccgcccuccuguggauggccaacguggagccccacuggaucgccgccagcaucauccuggaguucuuccucauggugcugcugaucccggagcccgaccgccagcggacgccccaggacaaccagcucgcguacgucgugaucggccugcuguucaugauccucaccguggccgccaacgagauggggcugcuggagacgaccaagaaggaccucggcaucggguacgucgccgccgagaaccagcaccacgcgaccaugcuggacguggaccugcgcccggccuccgccuggacccucuacgccguggccacgaccgucaucacccccaugaugcgccacaccaucgagaacacgaccgcgaacaucagccugaccgccaucgccaaccaggccgccauccugaugggccucgacaagggcuggcccaucuccaagauggacaucggggugccccugcuggcgcucggcugcuacagccaggugaacccgcugacccugacggccgccguccucaugcugguggcccacuacgcgaucaucgggcccggccugcaggccaaggccacccgggaggcccagaagcgcaccgccgcggggaucaugaagaaccccaccguggacggcaucgucgccaucgaccucgaccccgugguguacgacgccaaguucgagaagcagcugggccagaucaugcugcucauccugugcacgucccagauccugcucaugcggaccaccugggcccugugcgagagcaucacccuggccacggggccgcucaccacccugugggagggcucccccgggaaguucuggaacaccacgaucgcggucagcauggccaacaucuuccgcggcuccuaccuggccggcgccgggcucgccuucagccugaugaagucccugggcgggggccggcgcgggaccggcgcgcagggcgagacccucggggagaaguggaagcggcagcugaaccagcugagcaagagcgaguucaacaccuacaagcgcuccggcaucauggagguggaccggagcgaggccaaggaggggcucaagcgcggcgagacgaccaagcacgccgugucccgggggaccgccaagcugcgcugguucgucgagcggaaccuggugaagcccgagggcaaggugaucgaccugggcugcgggcgcggcggguggagcuacuacugcgcgggccucaagaaggucaccgaggugaagggguacacgaagggcggccccgggcacgaggagccgauccccauggccaccuacggcuggaaccuggugaagcuguacuccgggaaggacgucuucuucacgccgcccgagaagugcgacacccuccugugcgacaucggcgagagcuccccgaaccccaccaucgaggaggggcggacgcugcgcgugcucaagaugguggagcccuggcugcggggcaaccaguucugcaucaagauccugaaccccuacaugccgagcgucguggagacccucgagcagaugcagcgcaagcacggcgggaugcuggugcggaacccccugucccgcaacagcacccacgagauguacugggucuccugcggcaccgggaacaucgugagcgccgugaacaugacgucccgcaugcuccugaaccgguucaccaugacccaccgcaagcccaccuacgagcgggacgucgaccugggcgccggcacgcgccacguggccguggagcccgaggucgcgaaccucgacaucaucgggcagcggaucgagaacaucaagaacgagcacaagagcaccuggcacuacgacgaggacaacccguacaagaccugggccuaccacggcuccuacgaggugaagcccagcggguccgccagcuccauggugaacggcgucgugcgccugcugaccaagcccugggacgucauccccauggugacgcagaucgccaugaccgacaccaccccguucgggcagcagcggguguucaaggagaaggucgacacgcgcacgccccgggccaagcgcggcaccgcgcagaucauggaggugaccgccaaguggcucuggggcuuccugagccggaacaagaagccccgcaucugcacgcgggaggaguucacccgcaaggugcggagcaacgccgccaucggggccgucuucguggacgagaaccaguggaacuccgcgaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagcuucuccggcguggagggggagggccugcacaagcucggguacauccugcgcgacaucagcaagaucccgggcggcaacauguacgccgacgacaccgccgggugggacacgcggaucaccgaggacgaccugcagaacgaggcgaagaucaccgacaucauggagcccgagcacgcccuccuggccaccuccaucuucaagcugacguaccagaacaaggucgugcgcgugcagcggcccgccaagaacggcaccgucauggacgugaucagccgccgggaccagcgcggguccggccaggugggcaccuacgggcucaacaccuucacgaacauggagguccagcugauccggcagauggagagcgagggcaucuuccugcccuccgagcucgagaccccgaaccuggccgagcgcgugcugaacuggcucgagaagcacgggaccgagcggcugaagcgcauggcgaucagcggcgacgacugcguggucaagcccguggacgaccgguucgccaccgcccugaucgcccucaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcuggucgggcgggcccgcgugucccagggcgcgggguggagccuccgggagacggccugccugggcaaguccuacgcccagauguggcagcugauguacuuccaccgccgggaccuccgccuggccgccaacgcgaucugcagcgccgugcccgucgacugggugcccaccagccgcaccaccugguccauccacgcccaccaccaguggaugaccacggaggacaugcugagcguguggaaccgggucuggaucgaggagaacccguggauggaggacaagacccacguguccagcugggaggaggugcccuaccucgggaagcgcgaggaccaguggugcggcucccugaucggccugaccgcccgggcgaccugggccacgaacauccaggucgccaucaaccaggugcgccggcucaucgggaacgagaacuaccuggacuacaugaccagcaugaagcgcuucaagaacgaguccgaccccgagggcgcccugugguga

SEQ ID NO: 8204 - RNA, 9879 nt, Artificial Sequence
  derived and/or modified CDS sequence (opt1) from DENV-1__FJ205872__SS-prME
agcgugaccaugcugcucaugcugcugcccaccgcccucgccuuccaccugaccacccggggcggggagccccacaugaucguguccaagcaggagcggggcaagagccuccucuucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacgcgcaccgagaccuggaugagcuccgagggcgccuggaagcagauccagaagguggagaccugggcccugcggcaccccggguucacggugaccgccuucuuccuggcgcacgccaucggcaccagcaucacccagaaggggaucaucuucauccuccugaugcuggugacgcccuccauggccaugcgcugcgugggcaucggcaaccgggacuucgucgaggggcucagcggcgccaccuggguggacgugguccuggagcacggguccugcgugaccaccauggccaaggacaagcccacgcuggacaucgagcuccugaagaccgaggugaccaaccccgcgguccugcgcaagcucugcaucgaggccaagaucagcaacaccacgaccgacucccggugcccgacccagggcgaggccacccugguggaggagcaggacagcaacuucgugugccgccggacguucgucgaccgcggcugggggaacggcugcgggcuguucggcaaggggucccuccugaccugcgccaaguucaagugcgugaccaagcuggagggcaagaucgugcaguacgagaaccucaaguacagcgucaucgugaccgugcacacgggcgaccagcaccaggucgggaacgagaccaccgagcacggcaccaucgccaccaucacgccccaggcgcccaccuccgagauccagcugaccgacuacggggcccugacccucgacugcagcccccggacgggccuggacuucaacgagauggugcugcucaccaugaaggagaaguccuggcugguccacaagcagugguuccuggaccucccgcugcccuggaccagcggggccagcaccucccaggagacguggaaccgccaggaccugcucgugaccuucaagaccgcccacgccaagaagcaggagguggucgugcugggcagccaggagggcgcgaugcacaccgcccugacgggggccaccgagauccagaccuccggcaccacgaccaucuucgccgggcaccucaagugccggcugaagauggacaagcugacccucaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccugaucacggccaacccgaucgugaccgacaaggagaagcccgucaacaucgagaccgagccgcccuucggggaguccuacaucguggugggcgccggcgagaaggcgcucaagcugagcugguucaagaagggguccagcaucggcaagauguucgaggccaccgcccgcggggcccgccggauggccauccugggcgacacggcgugggacuucggguccaucggcggcgucuucaccagcguggggaagcucgugcaccaggucuucggcgccgccuacggggugcuguucuccggcgugagcuggaccaugaagaucgggaucggcauccugcucaccuggcugggccugaacucccgcagcacgucccucagcaugaccugcaucgccgucgggauggugacccuguaccugggcgugaugguccaggccgacuccgggugcgugaucaacuggaagggccgcgagcucaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucaccguggucgugggggacgcgaacggcauccucgcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcugcgggacuccuacacccagaugugcgaccaccgccucaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccugcgcuuccgcggggaggacggcugcugguacgggauggagauccgccccgugaaggagaaggaggagaaccuggugcggagcauggucagcgccggcuccggcgagguggacagcuucucccucgggauccugugcgugagcaucaugaucgaggaggucaugcgcucccgguggagccgcaagaugcugaugacgggcacccucgccguguuccugcugcucaucauggggcagcugaccuggaacgaccugauccgccucugcaucauggugggcgcgaacgccuccgaccggauggggaugggcaccacguaccuggcccugauggccaccuucaagaugcgcccgauguucgccgucggccuccuguuccggcgccugaccagccgggaggugcuccugcugaccaucgggcucucccugguggcgagcgucgagcugcccaacucccucgaggagcugggcgacgggcuggccaugggcaucaugaugcucaagcugcugacggaguuccagccccaccagcucuggaccacccugcugagccucaccuucaucaagacgacccugucccuggacuacgccuggcgcaccauggccauggugcucagcaucgucucccuguucccccugugccucagcaccacgucccagaagaccaccuggcugccggugcugcucggcagcuucgggugcaagccccugaccauguuccugaucacggagaacaagaucuggggccggaaguccuggccccucaacgaggggaucauggcgaucggcaucgugagcauccugcugagcucccuccugaagaacgacgucccccuggccgggccgcucaucgccggcggcaugcugaucgccugcuacgugaucagcggguccagcgccgaccugucccucgagaaggcggccgaggugagcugggaggaggaggccgagcacuccggcaccagccacaacauccuggucgaggugcaggacgacgggaccaugaagaucaaggacgaggagcgcgacgacacccugaccauccuccugaaggccacgcugcucgccguguccggcgucuaccccaugagcauccccgcgacccuguucgugugguacuucuggcagaagaagaagcagcgguccggggugcugugggacacccccagcccgcccgaggucgagcgcgccgugcucgacgacggcaucuaccggauccugcagcgcggccugcuggggcggucccaggugggcgucgggguguuccaggacggcguguuccacaccauguggcacgucacgcgcggggccgugcucauguaccagggcaagcggcuggagcccagcugggccuccgugaagaaggaccugaucagcuacggcgggggcuggcgcuuccagggguccuggaacaccggcgaggagguccaggugaucgccguggagcccgggaagaacccgaagaacguccagaccacccccggcacguucaagacccccgagggcgaggugggggcgaucgcccucgacuucaagcccggcaccagcggguccccgaucgugaaccgggagggcaagaucgucggccuguacgggaacggcguggugaccacgagcgggaccuacgucagcgccaucgcccaggccaagaccucccaggagggcccccugcccgagaucgaggaggagguguucaagaagcgcaaccucaccaucauggaccugcacccggggagcggcaagacgcggcgcuaccugcccgcgaucgugcgggaggccaucaagcgcaagcuccgcacccugauccuggcccccacccgggucguggccuccgagauggcggaggcccucaagggcaugcccauccgcuaccagaccacggccgucaagagcgagcacaccgggcgggagaucgucgaccugaugugccacgccaccuucaccaugcgccugcucuccccggugcgggugcccaacuacaacaugaucaucauggacgaggcccacuucacggaccccgcgagcaucgccgcccgcggcuacaucuccacccgggucgggaugggcgaggccgccgcgaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcugagccgcaagaccuucgacaccgaguaccagaagacgcggaacaacgacugggacuacgucgugaccaccgacaucuccgagaugggggcgaacuuccgcgccgaccgggugaucgacccccgccggugccucaagcccgucauccugaaggacggccccgagcgcgugauccuggccgggccgaugcccgugaccgucgccagcgcggcccagcggcgcggccgcaucggccggaaccagaacaaggagggggaccaguacguguacaugggccagccccucaacaacgacgaggaccacgcccacuggacggaggccaagaugcugcuggacaacaucaacacccccgaggggaucaucccggcccucuucgagcccgagcgcgagaaguccgcggccaucgacggcgaguaccggcugcgcggggaggcccggaagaccuucgucgagcugaugcgccggggcgaccuccccguguggcugagcuacaagguggccuccgagggcuuccaguacagcgaccgccgguggugcuucgacggggagcgcaacaaccagguccuggaggagaacauggacguggagaucuggaccaaggagggcgagcggaagaagcuccgcccccgguggcuggacgcccgcacguacagcgacccgcuggcgcuccgggaguucaaggaguucgccgccgggcgccgguccgugagcggcgaccugauccuggagaucggcaagcucccccagcaccugacccugcgcgcccagaacgcccucgacaaccuggucaugcugcacaacuccgagcagggcgggaaggcguaccggcacgccauggaggagcuccccgacaccaucgagacccugaugcugcucgcccugaucgccgcgcugaccgggggcgugacccucuucuuccugagcgggaagggccugggcaagaccuccaucgggcuccugugcgugauggccagcuccgcccugcucuggauggccaacgucgagccccacuggaucgccgcgagcaucauccuggaguucuuccugauggugcuccugaucccggagcccgaccgccagcggacgccccaggacaaccagcuggccuacguggucaucggccuccuguucaugauccugaccguggccgccaacgagauggggcuccuggagacgaccaagaaggaccugggcaucggguacguggccgcggagaaccagcaccacgccaccaugcucgacgucgaccugcgcccggccuccgccuggacccuguacgccguggcgacgaccgugaucacccccaugaugcgccacaccaucgagaacacgaccgccaacaucagccucaccgccaucgccaaccaggccgcgauccugaugggccuggacaagggcuggcccaucuccaagauggacaucggggucccccuccuggcccugggcugcuacagccaggugaacccgcucacccugacggccgccgugcugaugcucgucgcgcacuacgccaucaucgggcccggccugcaggccaaggccacccgggaggcccagaagcgcaccgcggccgggaucaugaagaaccccaccguggacggcaucguggccaucgaccuggaccccgucguguacgacgccaaguucgagaagcagcucggccagaucaugcugcugauccucugcacgucccagauccugcugaugcggaccaccugggcccucugcgagagcaucacccuggcgacggggccgcugaccacccucugggagggcucccccgggaaguucuggaacaccacgaucgccgugagcauggccaacaucuuccgcggcuccuaccuggccggcgccgggcuggcguucagccucaugaagucccugggcgggggccggcgcgggaccggcgcccagggcgagacccugggggagaaguggaagcggcagcucaaccagcugagcaagagcgaguucaacaccuacaagcgcuccggcaucauggaggucgaccggagcgaggccaaggaggggcugaagcgcggcgagacgaccaagcacgccgugucccgggggaccgcgaagcuccgcugguucguggagcggaaccuggucaagcccgagggcaaggugaucgaccugggcugcgggcgcggcggguggagcuacuacugcgccggccugaagaaggugaccgaggucaagggguacacgaagggcggccccgggcacgaggagccgauccccauggccaccuacggcuggaaccucgugaagcuguacuccgggaaggacguguucuucacgccgcccgagaagugcgacacccugcucugcgacaucggcgagagcuccccgaaccccaccaucgaggaggggcggacgcugcgcguccugaagaugguggagcccuggcuccggggcaaccaguucugcaucaagauccugaaccccuacaugccgagcguggucgagacccuggagcagaugcagcgcaagcacggcgggaugcucgugcggaacccccugucccgcaacagcacccacgagauguacuggguguccugcggcaccgggaacaucgucagcgccgugaacaugacgucccgcaugcugcucaaccgguucaccaugacccaccgcaagcccaccuacgagcgggacguggaccugggcgccggcacgcgccacgucgcgguggagcccgagguggccaaccuggacaucaucgggcagcggaucgagaacaucaagaacgagcacaagagcaccuggcacuacgacgaggacaacccguacaagaccugggccuaccacggcuccuacgaggucaagcccagcggguccgccagcuccauggugaacggcgugguccgccuccugaccaagcccugggacgugauccccauggucacgcagaucgccaugaccgacaccaccccguucgggcagcagcggguguucaaggagaagguggacacgcgcacgccccgggcgaagcgcggcaccgcccagaucauggaggucaccgccaaguggcuguggggcuuccucagccggaacaagaagccccgcaucugcacgcgggaggaguucacccgcaaggugcggagcaacgccgccaucggggcgguguucgucgacgagaaccaguggaacuccgccaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggcgaagggcagccgcgccaucugguacauguggcugggcgcccgguuccuggaguucgaggcccucggguucaugaacgaggaccacugguucucccgcgagaacagcuucuccggcguggagggggagggccugcacaagcugggguacauccuccgcgacaucagcaagaucccgggcggcaacauguacgccgacgacaccgcggggugggacacgcggaucaccgaggacgaccugcagaacgaggccaagaucaccgacaucauggagcccgagcacgcccugcucgccaccuccaucuucaagcugacguaccagaacaaggugguccgcgugcagcggcccgccaagaacggcaccgugauggacgucaucagccgccgggaccagcgcggguccggccaggugggcaccuacgggcugaacaccuucacgaacauggaggugcagcucauccggcagauggagagcgagggcaucuuccugcccuccgagcuggagaccccgaaccucgcggagcgcguccugaacuggcuggagaagcacgggaccgagcggcucaagcgcauggccaucagcggcgacgacugcguggugaagcccgucgacgaccgguucgccaccgcccugaucgcccugaacgacauggggaaggugcgcaaggacaucccccagugggagcccuccaagggcuggaacgacuggcagcaggucccguucugcagccaccacuuccaccagcucaucaugaaggacggccgggagaucgucgugcccugccgcaaccaggacgagcugguggggcgggcgcgcgucucccagggcgccggguggagccugcgggagacggccugccucggcaaguccuacgcccagauguggcagcugauguacuuccaccgccgggaccugcgccucgccgcgaacgccaucugcagcgccgugcccguggacuggguccccaccagccgcaccaccugguccauccacgcccaccaccaguggaugaccacggaggacaugcugagcguguggaaccggguguggaucgaggagaacccguggauggaggacaagacccacgucuccagcugggaggaggugcccuaccuggggaagcgcgaggaccaguggugcggcucccucaucggccugaccgcgcgggccaccugggccacgaacauccagguggccaucaaccagguccgccggcugaucgggaacgagaacuaccucgacuacaugaccagcaugaagcgcuucaagaacgaguccgaccccgagggcgcccugugguga

SEQ ID NO: 8205 - RNA, 9879 nt, Artificial Sequence
  derived and/or modified CDS sequence (opt1) from DENV-1__FJ205873__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccgucgcccuggcgccccacgugggccuggggcucgagacccgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggccguguuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccgucgggcugcuguuccggaagcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcggaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccgcaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgggacgacacccucaccauccugcugaaggccacgcuccuggccguguccggcgucuaccccaugagcauccccgcgacccuguucgugugguacuucuggcagaagaagaagcagcgcuccggggugcucugggacacccccagcccgcccgaggucgagcgggccgugcuggacgacggcaucuaccgcauccugcagcggggccugcucgggcgcucccaggugggcgucgggguguuccaggacggcguguuccacaccauguggcacgucacgcgcggggccgugcugauguaccagggcaagcgccuggagcccagcugggccuccgugaagaaggaccucaucagcuacggcgggggcuggcgguuccagggguccuggaacaccggcgaggagguccaggugaucgccguggagcccgggaagaacccgaagaacguccagaccacccccggcacguucaagacccccgagggcgaggugggggcgaucgcccuggacuucaagcccggcaccagcggguccccgaucgugaaccgcgagggcaaggucgugggccuguacgggaacggcguggucaccacgagcgggaccuacgugagcgccaucgcccaggccaagaccucccaggagggcccccuccccgagaucgaggaggagguguucaagaagcggaaccugaccaucauggaccugcacccggggagcggcaagacgcgccgguaccuccccgcgaucguccgcgaggccaucaagcggaagcugcgcacccugauccucgcccccacccgcgugguggccuccgagauggcggaggcccugaagggcaugcccauccgguaccagaccacggccgucaagagcgagcacaccgggcgcgagaucguggaccugaugugccacgccaccuucaccaugcggcuccuguccccggugcgcguccccaacuacaacaugaucaucauggacgaggcccacuucacggaccccgcgagcaucgccgcccggggcuacaucuccacccgcguggggaugggcgaggccgccgcgaucuucaugaccgccacgccgcccgggagcguggaggccuucccccaguccaacgccgucauccaggacgaggagcgggacauccccgagcgcagcuggaacuccggcuacgacuggaucacggacuuccccggcaagaccgugugguucgugcccagcaucaaguccgggaacgacaucgccaacugccugcggaagaacggcaagcgcgucauccagcucagccggaagaccuucgacaccgaguaccagaagacgcgcaacaacgacugggacuacguggugaccaccgacaucuccgagaugggggcgaacuuccgggccgaccgcgucaucgacccccggcgcugccugaagcccgugauccugaaggacggccccgagcgggugauccucgccgggccgaugcccgucaccguggccagcgcggcccagcgccggggccgcaucggccgcaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgggagaaguccgcggccaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggacguacagcgacccgcucgcgcugcgcgaguucaaggaguucgccgccgggcggcgcuccgucagcggcgaccugauccucgagaucggcaagcugccccagcaccugacccuccgggcccagaacgcccuggacaaccuggugaugcuccacaacuccgagcagggcgggaaggcguaccgccacgccauggaggagcugcccgacaccaucgagacccugaugcuccuggcccugaucgccgugcucaccgggggcgucacgcuguucuuccugagcgggaagggccucggcaagaccuccaucgggcugcugugcgugauggcgagcuccgcccuccuguggauggccaacguggagccccacuggaucgccgccagcaucauccuggaguucuuccucaugguccugcugaucccggagcccgaccggcagcgcacgccccaggacaaccagcucgcguacguggugaucggccugcuguucaugauccucaccgucgccgccaacgagauggggcugcuggagacgaccaagaaggaccucggcaucgggcacguggccgccgagaaccagcaccacgcgaccaugcuggacguggaccugcggccggccuccgccuggacccucuacgccgucgccacgaccgugaucacccccaugaugcgccacaccaucgagaacacgaccgcgaacaucagccugaccgccaucgccaaccaggccgccauccugaugggccucgacaagggcuggcccaucuccaagauggacaucggggugccccugcuggcgcucggcugcuacagccaggucaacccgcugacccugacggccgccgugcucaugcugguggcccacuacgcgaucaucgggcccggccugcaggccaaggccacccgcgaggcccagaagcggaccgccgcggggaucaugaagaaccccaccgucgacggcaucguggccaucgaccucgaccccguggucuacgacgccaaguucgagaagcagcugggccagaucaugcugcucauccugugcacgucccagauccugcucaugcgcaccaccugggcccugugcgagagcaucacccuggccacggggccgcucaccacccugugggagggcucccccgggaaguucuggaacaccacgaucgcggugagcauggccaacaucuuccggggcuccuaccuggccggcgccgggcucgccuucagccugaugaagucccugggcgggggccgccgggggaccggcgcgcagggcgagacccucggggagaaguggaagcgccagcugaaccagcugagcaagagcgaguucaacaccuacaagcgguccggcaucauggagguggaccgcagcgaggccaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgcgggccucaagaaggugaccgaggugaagggguacacgaagggcggccccgggcacgaggagccgauccccauggccaccuacggcuggaaccuggucaagcuguacuccgggaaggacguguucuucacgccgcccgagaagugcgacacccuccugugcgacaucggcgagagcuccccgaaccccaccaucgaggaggggcgcacgcugcgggugcucaagauggucgagcccuggcugcgcggcaaccaguucugcaucaagauccugaaccccuacaugccgagcgugguggagacccucgagcagaugcagcggaagcacggcgggaugcugguccgcaacccccugucccggaacagcacccacgagauguacuggguguccugcggcaccgggaacaucgugagcgccgucaacaugacgucccgcaugcuccugaaccgcuucaccaugacccaccggaagcccaccuacgagcgcgacguggaccugggcgccggcacgcggcacguggccgucgagcccgagguggcgaaccucgacaucaucgggcagcgcaucgagaacaucaagaacgagcacaagagcaccuggcacuacgacgaggacaacccguacaagaccugggccuaccacggcuccuacgaggugaagcccagcggguccgccagcuccauggucaacggcgugguccggcugcugaccaagcccugggacgugauccccauggugacgcagaucgccaugaccgacaccaccccguucgggcagcagcgcgucuucaaggagaagguggacacgcggacgccccgggccaagcggggcaccgcgcagaucauggaggugaccgccaaguggcucuggggcuuccugagccgcaacaagaagccccggaucugcacgcgcgaggaguucacccggaagguccgcagcaacgccgccaucggggccguguucguggacgagaaccaguggaacuccgcgaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgggagaacagcuucuccggcgucgagggggagggccugcacaagcucggguacauccugcgcgacaucagcaagaucccgggcggcaacauguacgccgacgacaccgccgggugggacacgcgcaucaccgaggacgaccugcagaacgaggcgaagaucaccgacaucauggagcccgagcacgcccuccuggccaccuccaucuucaagcugacguaccagaacaagguggugcggguccagcgccccgccaagaacggcaccgugauggacgugaucagccggcgcgaccagcggggguccggccaggucggcaccuacgggcucaacaccuucacgaacauggaggugcagcugauccgccagauggagagcgagggcaucuuccugcccuccgagcucgagaccccgaaccuggccgagcgggugcugaacuggcucgagaagcacgggaccgagcgccugaagcggauggcgaucagcggcgacgacugcgucgugaagcccguggacgaccgcuucgccaccgcccugaucgcccucaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcugguggggcgcgcccgggugucccagggcgcgggguggagccuccgcgagacggccugccugggcaaguccuacgcccagauguggcagcugauguacuuccaccggcgcgaccuccggcuggccgccaacgcgaucugcagcgccguccccguggacugggugcccaccagccgcaccaccugguccauccacgcccaccaccaguggaugaccacggaggacaugcugagcgucuggaaccgcguguggaucgaggagaacccguggauggaggacaagacccacguguccagcugggaggagguccccuaccucgggaagcgggaggaccaguggugcggcucccugaucggccugaccgcccgcgcgaccugggccacgaacauccagguggccaucaaccaggugcggcgccucaucgggaacgagaacuaccuggacuacaugaccagcaugaagcgguucaagaacgaguccgaccccgagggcgcccugugguga

SEQ ID NO: 8206 - RNA, 9879 nt, Artificial Sequence
  derived and/or modified CDS sequence (opt1) from DENV-1__FJ390379__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggcgcaagaugauccggccccagcccauggagcaccgcuacagcuggaaguccuggggcaaggccaagaucaucggcgccgacauccagaacagcaccuucaucaucgacgggcccgacacgccggagugccccgacgaccagcgggcguggaacaucugggagguggaggacuacggcuucgggaucuucaccaccaacaucuggcugaagcuccgcgacuccuacacccagaugugcgaccaccggcugaugagcgccgccaucaaggacuccaaggccguccacgccgacaugggcuacuggaucgagagcgagaagaacgagacguggaagcuggcgcgcgccuccuucaucgaggugaagaccugcaucuggcccaagagccacacccucugguccaacggcgugcuggagagcgagaugaucauccccaagaucuacgggggcccgaucucccagcacaacuaccggcccggguacuucacccagacggccggccccuggcaccuggggaagcucgagcuggacuucgaccugugcgagggcaccaccgucgugguggacgagcacugcggcaaccgcgggccgagccuccggaccacgaccgucaccggcaagaucauccacgaguggugcugccgcuccugcacccugccgccccugcgguuccgcggggaggacggcugcugguacgggauggagauccggcccgugaaggagaaggaggagaaccucgugcgcagcauggucagcgccggcuccggcgagguggacagcuucucccuggggauccugugcgugagcaucaugaucgaggaggucaugcggucccgcuggagccgcaagaugcucaugacgggcacccuggccguguuccugcuccugaucauggggcagcugaccuggaacgaccucauccggcugugcaucauggugggcgcgaacgccuccgaccgcauggggaugggcaccacguaccuggcccucauggccaccuucaagaugcggccgauguucgccgucgggcugcuguuccgccggcucaccagccgcgaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcggaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccgcaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgggacgacacccucaccauccugcugaaggccacgcuccuggccaucuccggcguguaccccaugagcauccccgcgacccuguucgucugguacuucuggcagaagaagaagcagcgcuccggggugcucugggacacccccagcccgcccgagguggagcgggccguccuggacgacggcaucuaccgcauccugcagcggggccugcucgggcgcucccaggugggcgugggggucuuccaggacggcguguuccacaccauguggcacgugacgcgcggggccguccugauguaccagggcaagcgccuggagcccagcugggccuccgugaagaaggaccucaucagcuacggcgggggcuggcgguuccagggguccuggaacaccggcgaggaggugcaggucaucgccguggagcccgggaagaacccgaagaacgugcagaccacccccggcacguucaagacccccgagggcgaggucggggcgaucgcccuggacuucaagcccggcaccagcggguccccgaucgugaaccgcgagggcaagaucgugggccuguacgggaacggcgucgugaccacgagcgggaccuacgugagcgccaucgcccaggccaagaccucccaggagggcccccuccccgagaucgaggaggaggucuucaagaagcggaaccugaccaucauggaccugcacccggggagcggcaagacgcgccgguaccuccccgcgaucgugcgcgaggccaucaagcgcaagcugcggacccugauccucgcccccacccgcguggucgccuccgagauggcggaggcccugaagggcaugcccauccgguaccagaccacggccgucaagagcgagcacaccgggcgcgagaucguggaccugaugugccacgccaccuucaccaugcggcuccuguccccgguccgcgugcccaacuacaacaugaucaucauggacgaggcccacuucacggaccccgcgagcaucgccgcccggggcuacaucuccacccgcguggggaugggcgaggccgccgcgaucuucaugaccgccacgccgcccgggagcgucgaggccuucccccaguccaacgccgugauccaggacgaggagcgggacauccccgagcgcagcuggaacuccggcuacgacuggaucacggacuuccccggcaagaccgugugguucguccccagcaucaaguccgggaacgacaucgccaacugccugcggaagaacggcaagcgcgugauccagcucagccggaagaccuucgacaccgaguaccagaagacgcgcaacaacgacugggacuacguggucaccaccgacaucuccgagaugggggcgaacuuccgggccgaccgcgugaucgacccccggcgcugccugaagcccgugauccugaaggacggccccgagcgggucauccucgccgggccgaugcccgugaccguggccagcgcggcccagcgccgcggccggaucggccgcaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgggagaaguccgcggccaucgacggcgaguaccgccugcgcggggaggcccgcaagaccuucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggacguacagcgacccgcucgcgcugcgcgaguucaaggaguucgccgccgggcggcgcuccgugagcggcgaccugauccucgagaucggcaagcugccccagcaccugacccuccgggcccagaacgcccuggacaaccuggugaugcuccacaacuccgagcagggcgggaaggcguaccgccacgccauggaggagcugcccgacaccaucgagacccugaugcuccuggcccugaucgccguccucaccgggggcgugacgcuguucuuccugagcgggaagggccucggcaagaccuccaucgggcugcugugcgugauggcgagcuccgcccuccuguggauggccaacgucgagccccacuggaucgccgccagcaucauccuggaguucuuccucauggugcugcugaucccggagcccgaccggcagcgcacgccccaggacaaccagcucgcguacguggucaucggccugcuguucaugauccucaccguggccgccaacgagauggggcugcuggagacgaccaagaaggaccucggcaucgggcacguggccgccgagaaccagcaccacgcgaccaugcuggacgucgaccugcgcccggccuccgccuggacccucuacgccguggccacgaccgugaucacccccaugaugcggcacaccaucgagaacacgaccgcgaacaucagccugaccgccaucgccaaccaggccgccauccugaugggccucgacaagggcuggcccaucuccaagauggacaucggggucccccugcuggcgcucggcugcuacagccaggugaacccgcugacccugacggccgccgugcucaugcuggucgcccacuacgcgaucaucgggcccggccugcaggccaaggccacccgcgaggcccagaagcggaccgccgcggggaucaugaagaaccccaccguggacggcaucguggccaucgaccucgaccccgucguguacgacgccaaguucgagaagcagcugggccagaucaugcugcucauccugugcacgucccagauccugcucaugcgcaccaccugggcccugugcgagagcaucacccuggccacggggccgcucaccacccugugggagggcucccccgggaaguucuggaacaccacgaucgcggugagcauggccaacaucuuccggggcuccuaccuggccggcgccgggcucgccuucagccugaugaagucccugggcgggggccgccgggggaccggcgcgcagggcgagacccucggggagaaguggaagcgccagcugaaccagcugagcaagagcgaguucaacaccuacaagcgguccggcaucauggaggucgaccgcagcgaggccaaggaggggcucaagcggggcgagacgaccaagcacgccgugucccgcgggaccgccaagcugcggugguucguggagcgcaaccuggucaagcccgagggcaaggugaucgaccugggcugcgggcggggcggguggagcuacuacugcgcgggccucaagaaggugaccgaggucaagggguacacgaagggcggccccgggcacgaggagccggugcccauggccaccuacggcuggaaccuggugaagcuguacuccgggaaggacgucuucuucacgccgcccgagaagugcgacacccuccugugcgacaucggcgagagcuccccgaaccccaccaucgaggaggggcgcacgcugcgggugcucaagaugguggagcccuggcugcgcggcaaccaguucugcaucaagauccugaaccccuacaugccgagcgucguggagacccucgagcagaugcagcggaagcacggcgggaugcuggugcgcaacccccugucccgcaacagcacccacgagauguacugggucuccugcggcaccgggaacaucgugagcgccgugaacaugacgucccggaugcuccugaaccgcuucaccaugacccaccggaagcccaccuacgagcgcgacgucgaccugggcgccggcacgcggcacguggccguggagcccgaggucgcgaaccucgacaucaucgggcagcgcaucgagaacaucaagaacgagcacaagagcaccuggcacuacgacgaggacaacccguacaagaccugggccuaccacggcuccuacgaggugaagcccagcggguccgccagcuccauggugaacggcgucgugcggcugcugaccaagcccugggacgucauccccauggugacgcagaucgccaugaccgacaccaccccguucgggcagcagcgcguguucaaggagaaggucgacacgcggacgccccgggccaagcggggcaccgcgcagaucauggaggugaccgccaaguggcucuggggcuuccugagccgcaacaagaagccccggaucugcacgcgcgaggaguucacccggaaggugcgcagcaacgccgccaucggggccgucuucguggacgagaaccaguggaacuccgcgaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcagccgggcgaucugguacauguggcugggcgcccgcuuccucgaguucgaggcccugggguucaugaacgaggaccacugguucucccgcgagaacagcuucuccggcguggagggggagggccugcacaagcucggguacauccugcgggacaucagcaagaucccgggcggcaacauguacgccgacgacaccgccgggugggacacgcgcaucaccgaggacgaccugcagaacgaggcgaagaucaccgacaucauggagcccgagcacgcccuccuggccaccuccaucuucaagcugacguaccagaacaaggucgugcgggugcagcgccccgccaagaacggcaccgucauggacgugaucagccggcgcgaccagcggggguccggccaggugggcaccuacgggcucaacaccuucacgaacauggagguccagcugauccgccagauggagagcgagggcaucuuccugcccuccgagcucgagaccccgaaccuggccgagcgggugcuggacuggcucgagaagcacgggaccgagcgccugaagcggauggcgaucagcggcgacgacugcguggucaagcccguggacgaccgcuucgccaccgcccugaucgcccucaacgacauggggaaggugcggaaggacaucccccagugggagcccuccaagggcuggaacgacuggcagcaggucccguucugcagccaccacuuccaccagcugaucaugaaggacggccgcgagaucguggugcccugccggaaccaggacgagcuggucgggcgcgcccgggugucccagggcgcgggguggagccuccgcgagacggccugccugggcaaguccuacgcccagauguggcagcugauguacuuccaccggcgcgaccuccgccuggccgccaacgcgaucugcagcgccgugcccgucgacugggugcccaccagccggaccaccugguccauccacgcccaccaccaguggaugaccacggaggacaugcugagcguguggaaccgcgucuggaucgaggagaacccguggauggaggacaagacccacguguccagcugggaggaggugcccuaccucgggaagcgggaggaccaguggugcggcucccugaucggccugaccgcccgcgcgaccugggccacgaacauccaggucgccaucaaccaggugcggcgccucaucgggaacgagaacuaccuggacuacaugaccagcaugaagcgguucaagaacgaguccgaccccgagggcgcccugugguga

SEQ ID NO: 8207 - RNA, 9879 nt, Artificial Sequence
  derived and/or modified CDS sequence (opt1) from DENV-1__FJ390380__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggugaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccuguucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgagcugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggugguguucuuccugcucaucauggggcagcugaccuggaacgaccugauccgccucugcaucauggucggcgccaacgcguccgaccggauggggaugggcaccacguaccuggcccugauggccaccuucaagaugcgcccgauguucgccguggggcuccuguuccggcgccugaccagccgggaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggcgcaccauggccaugguccucagcaucgugucccuguucccccugugccucagcaccacgucccagaagaccaccuggcugccggugcugcucggcagcuucgggugcaagccccugaccauguuccugaucacggagaacaagaucuggggccggaaguccuggccccucaacgaggggaucauggccaucggcaucgucagcauccugcugagcucccuccugaagaacgacgugccccuggcggggccgcucaucgccggcggcaugcugaucgccugcuacgugaucagcggguccagcgccgaccugucccucgagaaggccgcggaggucagcugggaggaggaggccgagcacuccggcaccagccacaacauccugguggaggugcaggacgacgggaccaugaagaucaaggacgaggagcgcgacgacacccugaccauccuccugaaggccacgcugcucgccgucuccggcguguaccccaugagcauccccgccaccuucuucgugugguacuucuggcagaagaagaagcagcgguccgggguccugugggacacccccagcccgcccgagguggagcgcgcggugcuggacgacggcaucuaccggauccuccagcgcggccugcuggggcggucccaggucggcguggggguguuccaggacggcgucuuccacaccauguggcacgugacgcgcggggccgugcugauguaccagggcaagcggcucgagcccagcugggccuccgucaagaaggaccugaucagcuacggcgggggcuggcgcuuccagggguccuggaacaccggcgaggagguccaggugaucgccgucgagcccgggaagaacccgaagaacgugcagaccacccccggcacguucaagacccccgagggcgaggugggggccaucgcgcuggacuucaagcccggcaccagcggguccccgaucgucaaccgggagggcaagaucgugggccucuacgggaacggcguggucaccacgagcgggaccuacgugagcgccaucgcccaggccaagaccucccaggagggcccccugcccgagaucgaggaggagguguucaagaagcgcaaccugaccaucauggaccuccacccggggagcggcaagacgcggcgcuaccugcccgccaucguccgggaggcgaucaagcgcaagcugcgcacccucauccuggcccccacccgggugguggccuccgagauggccgaggcgcugaagggcaugcccauccgcuaccagaccacggccgucaagagcgagcacaccgggcgggagaucguggaccucaugugccacgccaccuucaccaugcgccugcuguccccggugcggguccccaacuacaacaugaucaucauggacgaggcccacuucacggaccccgccagcaucgcggcccgcggcuacaucuccacccggguggggaugggcgaggccgccgccaucuucaugaccgcgacgccgcccgggagcguggaggccuucccccaguccaacgccgucauccaggacgaggagcgcgacauccccgagcggagcuggaacuccggcuacgacuggaucacggacuuccccggcaagaccgugugguucgugcccagcaucaaguccgggaacgacaucgccaacugccuccgcaagaacggcaagcgggucauccagcugagccgcaagaccuucgacaccgaguaccagaagacgcggaacaacgacugggacuacguggugaccaccgacaucuccgagaugggggccaacuuccgcgcggaccgggucaucgacccccgccggugccugaagcccgugauccucaaggacggccccgagcgcgugauccuggccgggccgaugcccgucaccguggccagcgccgcgcagcggcgcggccgcaucggccggaaccagaacaaggagggggaccaguacgucuacaugggccagccccugaacaacgacgaggaccacgcccacuggacggaggccaagaugcuccuggacaacaucaacacccccgaggggaucaucccggcccuguucgagcccgagcgcgagaaguccgccgcgaucgacggcgaguaccggcuccgcggggaggcccggaagaccuucguggagcugaugcgccggggcgaccugcccguguggcucagcuacaaggucgccuccgagggcuuccaguacagcgaccgccgguggugcuucgacggggagcgcaacaaccaggugcuggaggagaacauggacguggagaucuggaccaaggagggcgagcggaagaagcugcgcccccgguggcucgacgcccgcacguacagcgacccgcuggcccugcgggaguucaaggaguucgcggccgggcgccgguccgucagcggcgaccucauccuggagaucggcaagcugccccagcaccucacccugcgcgcccagaacgcccuggacaaccucgugaugcugcacaacuccgagcagggcgggaaggccuaccggcacgcgauggaggagcugcccgacaccaucgagacccucaugcugcuggcccucaucgccgugcugaccgggggcgucacgcuguucuuccucagcgggaagggccugggcaagaccuccaucgggcugcucugcgugauggccagcuccgcgcugcuguggauggccaacguggagccccacuggaucgccgccagcaucauccucgaguucuuccugaugguccugcucaucccggagcccgaccgccagcggacgccccaggacaaccagcuggccuacguggugaucggccuccucuucaugauccugaccgucgcggccaacgagauggggcugcucgagacgaccaagaaggaccugggcaucgggcacguggccgccgagaaccagcaccacgccaccaugcuggacguggaccuccgcccggcguccgccuggacccuguacgccgucgccacgaccgugaucacccccaugaugcgccacaccaucgagaacacgaccgccaacaucagccugaccgcgaucgccaaccaggccgccauccucaugggccuggacaagggcuggcccaucuccaagauggacaucggggugccccugcucgcccugggcugcuacagccaggucaacccgcugacccucacggcggccgugcugaugcugguggcccacuacgccaucaucgggcccggccuccaggcgaaggccacccgggaggcccagaagcgcaccgccgccgggaucaugaagaaccccaccgucgacggcaucguggcgaucgaccuggaccccguggucuacgacgccaaguucgagaagcagcugggccagaucaugcuccugauccugugcacgucccagauccuccugaugcggaccaccugggcccugugcgagagcaucacccucgccacggggccgcugaccacccugugggagggcucccccgggaaguucuggaacaccacgaucgccgugagcauggcgaacaucuuccgcggcuccuaccucgccggcgccgggcuggccuucagccugaugaagucccucggcgggggccggcgcgggaccggcgcccagggcgagacccugggggagaaguggaagcggcagcugaaccagcucagcaagagcgaguucaacaccuacaagcgcuccggcaucauggagguggaccggagcgaggcgaaggaggggcugaagcgcggcgagacgaccaagcacgccgucucccgggggaccgccaagcugcgcugguucguggagcggaaccucgugaagcccgagggcaaggucaucgaccugggcugcgggcgcggcggguggagcuacuacugcgccggccugaagaaggugaccgaggugaagggguacacgaagggcggccccgggcacgaggagccgauccccauggcgaccuacggcuggaaccuggucaagcucuacuccgggaaggacguguucuucacgccgcccgagaagugcgacacccugcugugcgacaucggcgagagcuccccgaaccccaccaucgaggaggggcggacgcuccgcgugcugaagauggucgagcccuggcugcggggcaaccaguucugcaucaagauccucaaccccuacaugccgagcgugguggagacccuggagcagaugcagcgcaagcacggcgggaugcugguccggaacccccucucccgcaacagcacccacgagauguacuggguguccugcggcaccgggaacaucgugagcgccgucaacaugacgucccgcaugcugcugaaccgguucaccaugacccaccgcaagcccaccuacgagcgggacguggaccucggcgccggcacgcgccacguggccgucgagcccgagguggccaaccuggacaucaucgggcagcggaucgagaacaucaagaacgagcacaagagcaccuggcacuacgacgaggacaacccguacaagaccugggcguaccacggcuccuacgaggugaagcccagcggguccgccagcuccauggucaacggcgugguccgccugcucaccaagcccugggacgugauccccauggugacgcagaucgccaugaccgacaccaccccguucgggcagcagcgggucuucaaggagaagguggacacgcgcacgccccgggccaagcgcggcaccgcccagaucauggaggugaccgcgaaguggcuguggggcuuccugagccggaacaagaagccccgcaucugcacgcgggaggaguucacccgcaagguccggagcaacgccgccaucggggccguguucguggacgagaaccaguggaacuccgccaaggaggcggucgaggacgagcgcuucugggaccucgugcaccgggagcgcgagcugcacaagcagggcaagugcgcgaccugcguguacaacaugauggggaagcgggagaagaagcugggcgaguucgggaaggccaagggcagccgcgccaucugguacauguggcucggcgcgcgguuccuggaguucgaggcccugggguucaugaacgaggaccacugguucucccgcgagaacagcuucuccggcgucgagggggagggccuccacaagcugggguacauccugcgcgacaucagcaagaucccgggcggcaacauguacgccgacgacaccgccgggugggacacgcggaucaccgaggacgaccuccagaacgaggccaagaucaccgacaucauggagcccgagcacgcgcugcuggccaccuccaucuucaagcucacguaccagaacaagguggugcgcguccagcggcccgccaagaacggcaccgugauggacgugaucagccgccgggaccagcgcggguccggccaggucggcaccuacgggcugaacaccuucacgaacauggaggugcagcugauccggcagauggagagcgagggcaucuuccuccccuccgagcuggagaccccgaaccuggccgagcgcgugcucaacuggcuggagaagcacgggaccgagcggcugaagcgcauggccaucagcggcgacgacugcgucgugaagcccguggacgaccgguucgcgaccgcccucaucgcccugaacgacauggggaagguccgcaaggacaucccccagugggagcccuccaagggcuggaacgacuggcagcaggucccguucugcagccaccacuuccaccagcugaucaugaaggacggccgggagaucgugguccccugccgcaaccaggacgagcucguggggcgggcccgcgugucccagggcgccggguggagccugcgggagacggcgugccugggcaaguccuacgcccagauguggcagcucauguacuuccaccgccgggaccugcgccuggccgccaacgccaucugcagcgcgguccccguggacugggugcccaccagccgcaccaccugguccauccacgcccaccaccaguggaugaccacggaggacaugcucagcgucuggaaccggguguggaucgaggagaacccguggauggaggacaagacccacguguccagcugggaggagguccccuaccuggggaagcgcgaggaccaguggugcggcucccugaucggccucaccgcccgggccaccugggcgacgaacauccagguggccaucaaccaggugcgccggcugaucgggaacgagaacuaccuggacuacaugaccagcaugaagcgcuucaagaacgaguccgaccccgagggcgcccucugguga

SEQ ID NO: 8208 - RNA, 9879 nt, Artificial Sequence
  derived and/or modified CDS sequence (opt1) from DENV-1__FJ205874__SS-prME
agcgugaccaugcugcucaugcugcugcccaccgugcucgccuuccaccugaccacccggggcggggagccccacaugaucgugggcaagcaggagcggggcaagagccuccuguucaagaccagcgccggggugaacaugugcacccugaucgccauggaccugggggagcucugcgaggacaccaugaccuacaagugcccccgcaucaccgaggccgagcccgacgacguggacugcuggugcaacgccaccgacaccugggugaccuacgggaccugcucccagaccggcgagcaccggcgggacaagcggagcguggcccuggcgccccacgucgggcugggccucgagacccgcaccgagaccuggauguccagcgagggggccuggaagcagauccagaagguggagaccugggcccugcggcaccccggcuucaccgugaucgccuucuuccuggcccacgcgaucgggaccuccaucacccagaagggcaucaucuucauccuccugaugcuggucacccccagcauggccaugcgcugcgugggcaucgggaaccgggacuucguggagggccucuccggggccacgugggucgacguggugcuggagcacggcagcugcgucaccaccauggccaagaacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggguggggcaacgggugcggccuguucgggaagggcucccuccugacgugcgccaaguucaagugcgucaccaagcuggagggcaagaucgugcaguacgagaaccucaaguacagcgugaucgucaccgugcacaccggggaccagcaccaggucggcaacgagacgaccgagcacgggaccaucgccaccaucacgccccaggcgcccacguccgagauccagcugaccgacuacggcgcccugacccucgacugcagcccccggaccgggcuggacuucaacgagauggugcugcucacgaugaaggagaaguccuggcuggugcacaagcagugguuccuggaccucccgcugcccuggaccagcggcgccuccaccagccaggagaccuggaaccgccaggaccugcucgucacguucaagaccgcccacgccaagaagcaggagguggugguccugggcagccaggagggggcgaugcacaccgcccugaccggcgccacggagauccagaccuccgggaccaccacgaucuucgccggccaccucaagugccggcugaagauggacaagcugacccucaaggggaugagcuacgugaugugcaccggcuccuucaagcuggagaaggagguggccgagacccagcacggcacgguccugguccaggugaaguacgaggggaccgacgcgcccugcaagaucccccugagcacccaggacgagaagggcgucacccagaacgggcgccucaucacggccaacccgaucgugaccgacaaggagaagcccgugaacaucgagaccgagccgcccuucggcgaguccuacaucaucgucggcgccggggagaaggcccugaagcugagcugguucaagaagggcuccagcaucgggaagauguucgaggcgaccgcccggggcgcccgccggauggccauccucggggacacggccugggacuucggcuccaucggcgggguguucaccagcgugggcaagcugguccaccagguguucgggaccgcguacggcgugcuguucuccggggucagcuggaccaugaagaucggcaucggcauccuccugacguggcuggggcucaacucccgcagcgccucccugagcaugaccugcaucgccgugggcauggugacccuguaccucggggucauggugcaggccgacuccggcugcgugaucaacuggaaggggcgcgagcugaagugcggcagcggcaucuucgucaccaacgaggugcacacguggaccgagcaguacaaguuccaggccgacuccccgaagcggcugagcgcggccaucgggaaggccugggaggagggcgugugcgggguccgcagcgccacccggcucgagaacaucauguggaagcagaucuccaacgagcugaaccacauccugcucgagaacgacaugaaguucaccgugguggucggcgacgccaacgggauccuggcgcagggcaagaagaugauccgcccccagcccauggagcacaaguacagcuggaaguccuggggcaaggccaagaucaucggggccgacauccagaacaccacguucaucaucgacggccccgacaccccggagugccccgacgaccagcgggccuggaacaucugggagguggaggacuacggguucggcaucuucaccaccaacaucuggcugaagcuccgcgacagcuacacgcagaugugcgaccaccggcugauguccgcggccaucaaggacagcaaggccgugcacgccgacaugggcuacuggaucgaguccgagaagaacgagaccuggcgccuggcccgggcgagcuucaucgaggucaagaccugcaucuggcccaagucccacacccucuggagcaacggggugcuggaguccgagaugaucauccccaagaucuacggcgggccgaucagccagcacaacuaccgccccggcuacuucacgcagaccgccgggcccuggcaccugggcaagcucgagcuggacuucgaccugugcgagggcaccaccguggucguggacgagcacugcgggaaccggggcccgucccuccgcacgaccaccgugaccgggaagaucauccacgaguggugcugccggagcugcacgcugccgccccugcgcuuccggggcgaggacgggugcugguacggcauggagauccgccccgucaaggagaaggaggagaaccucgugcgguccauggugagcgccggcuccggggaggucgacagcuucagccugggcauccugugccucuccaucaugaucgaggaggugaugcgcagccgguggucccgcaagaugcugaugaccgggacccuggccguguuccuccugcugaucaugggccagcucaccuggaacgaccugauccgccugugcaucauggucggggccaacgcgagcgaccggaugggcaugggcacgaccuaccucgcccugauggccaccuucaagaugcgcccgauguucgccguggggcuccuguuccggcgccugaccucccgggaggugcugcuccugacgaucggccugagccucgucgccuccguggagcugcccaacagccuggaggagcucggggacggccuggcgaugggcaucaugaugcugaagcuccugaccgaguuccagccccaccagcuguggaccacccuccugucccugacguucaucaagaccacccucagccuggacuacgccuggaagaccauggccaugguccuguccaucgugagccucuucccccugugccuguccacgaccagccagaagaccaccuggcucccggugcugcugggguccuucggcugcaagccccucacgauguuccugaucaccgagaacaagaucugggggcgcaagagcuggccccugaacgagggcaucauggccaucgggaucgucuccauccuccugagcucccugcucaagaacgacgugccccuggcgggcccgcugaucgccggcgggaugcucaucgccugcuacgugaucagcggcagcuccgccgaccugagccuggagaaggccgcggaggucuccugggaggaggaggccgagcacagcgggaccucccacaacauccucguggaggugcaggacgacggcaccaugaagaucaaggacgaggagcgggacgacacccugacgauccugcucaaggccacccugcuggccgucagcgggguguaccccauguccauccccgccacccucuucgugugguacuucuggcagaagaagaagcagcgcagcggcguccugugggacacccccuccccgcccgagguggagcgggcggugcuggacgacggcaucuaccgcauccugcagcgggggcuccugggccgcagccaggucggggugggcguguuccaggacggggucuuccacacgauguggcacgugacccggggcgccgugcugauguaccagggcaagcgccucgagcccuccugggccagcgucaagaaggaccugaucuccuacgggggcggguggcgguuccagggcagcuggaacaccggggaggagguccaggugaucgccgucgagcccggcaagaacccgaagaacgugcagaccacgcccggcaccuucaagacccccgagggggaggugggcgccgucgcgcuggacuucaagcccgggaccuccggcagcccgaucgugaaccgcgagggcaagaucguggggcucuacggcaacggggucgugacgaccuccggcaccuacgugagcgccaucgcccaggccaaggccucccaggaggggccccugcccgagaucgaggacgaggucuucaagaagcggaaccugaccaucauggaccuccacccgggcagcggcaagacgcgccgguaccugcccgcgaucgugcgcgaggccaucaagcggaagcugcgcacccucauccuggcccccacccgcguggucgccagcgagauggcggaggcccugaaggggaugcccauccgguaccagaccacggccgugaaguccgagcacaccggccgcgagaucguggaccucaugugccacgccaccuucaccaugcggcugcugagcccgguccgcgugcccaacuacaacaugaucaucauggacgaggcccacuucacggaccccgcguccaucgccgcccggggguacaucagcacccgcgugggcaugggggaggccgccgcgaucuucaugaccgccacgccgcccggcuccgucgaggccuucccccagagcaacgccgugauccaggacgaggagcgggacauccccgagcgcuccuggagcuccggcuacgacuggaucacggacuuccccgggaagaccgugugguucguccccagcaucaaguccggcaacgacaucgccaacugccuccggaagaacgggaagcgcgugauccagcugagccggaagaccuucgacaccgaguaccagaagacgaagaacaacgacugggacuacguggucaccaccgacaucuccgagaugggcgcgaacuuccgcgccgaccgggugaucgacccccgccggugccugaagcccgugauccucaaggacgggcccgagcgcgucauccuggccggcccgaugcccgugaccgucgccagcgcggcccagcggcgcggccggaucgggcgcaaccagaacaaggagggcgaccaguacguguacauggggcagccccugaacaacgacgaggaccacgcccacuggacggaggccaagaugcuccuggacaacaucaacacccccgagggcaucaucccggcccuguucgagcccgagcgcgagaaguccgcggccaucgacggggaguaccggcuccgcggcgaggcccggaagaccuucguggagcugaugaagcgcggcgaccugcccgucuggcucagcuacaagguggccuccgagggguuccaguacagcgaccggcgcuggugcuucgacggcgagcggaacaaccaggugcuggaggagaacauggacgucgagaucuggaccaaggagggggagcgcaagaagcugcggccccgcuggcucgacgcccggacguacuccgacccgcuggcgcugcgcgaguucaaggaguucgccgccggccggcgcagcgugagcggcgaccucauccuggagaucgggaagcugccccagcaccucacccugcgggcccagaacgcccuggacaaccucgugaugcugcacaacuccgagcagggcgggaaggcguaccgccacgccauggaggagcugcccgacaccaucgagacccucaugcugcuggcccucaucgccguccugaccggcggggugaugcuguucuuccucagcggcaagggccuggggaagacguccaucggccugcucugcgugauggcgagcuccgcccugcuguggauggccagcgucgagccccacuggaucgccgccuccaucauccucgaguucuuccugauggugcugcucaucccggagcccgaccggcagcgcacgccccaggacaaccagcuggcguacguggucaucgggcuccuguucaugauccugaccguggccgccaacgagaugggccugcucgagaccacgaagaaggaccuggggaucggccacguggccgccgagaaccaccaccacgucaccaugcuggacguggaccuccggccggcgagcgccuggacccuguacgccguggccaccacggucaucacccccaugaugcgccacaccaucgagaacaccacggccaacaucucccugaccgcgaucgccaaccaggccgccauccucaugggccuggacaagggguggcccaucagcaagauggacaucggcgugccccugcucgcccuggggugcuacucccaggugaacccgcugacccucaccgcggccguccugaugcugguggcccacuacgccaucaucggccccgggcuccaggcgaaggccacgcgggaggcccagaagcgcaccgccgccggcaucaugaagaaccccaccguggacggcaucgucgcgaucgaccuggaccccgugguguacgacgccaaguucgagaagcagcuggggcagaucaugcuccugauccugugcaccagccagauccuccugaugcgcacgaccugggcccugugcgaguccaucacccucgccaccggcccgcugacgacccugugggaggggagccccggcaaguucuggaacaccaccaucgccgucuccauggcgaacaucuuccggggcagcuaccucgccggggccggccuggccuucucccugaugaagucccucgggggcgggcgccggggcacgggcgcccagggggagacccugggcgagaaguggaagcgccagcugaaccagcucuccaagagcgaguucaacaccuacaagcggagcgggaucauggagguggaccgcuccgaggcgaaggagggccugaagcgcggggagaccacgaagcacgccgugagccgcggcaccgccaagcugcggugguucgucgagcgcaaccuggugaagcccgagggcaaggugaucgaccucgggugcggccgcgggggcugguccuacuacugcgccgggcugaagaaggucaccgaggugaagggcuacaccaagggcgggcccggccacgaggagccgauccccauggcgacguacggguggaaccuggugaagcuccacagcggcaaggacgucuucuucacgccgcccgagaagugcgacacccugcugugcgacaucggggaguccagcccgaaccccaccaucgaggagggccgcacccuccgggugcugaagaugguggagcccuggcugcgcggcaaccaguucugcaucaagauccucaaccccuacaugccguccgucguggagacgcuggagcagaugcagcggcgccacgggggcaugcuggugcggaacccccucagccgcaacuccacccacgagauguacugggucagcugcgggaccggcaacaucguguccgccgugaacaugaccagccggaugcugcugaaccgcuucacgauggcccaccgcaagcccaccuacgagcgggacgucgaccucggcgccgggacccgccacguggccguggagcccgaggucgcgaaccugggcaucaucgggcagcggaucgagaacaucaagaacgagcacaaguccaccuggcacuacgacgaggacaacccguacaagacgugggccuaccacggcagcuacgaggugaagcccuccgggagcgccuccagcauggucaacggcguggugcgccugcucaccaagcccugggacgucauccccauggugacccagaucgccaugaccgacacgaccccguucggccagcagcggguguucaaggagaaggucgacacccgcacgccccgggccaagcgcgggacggcgcagaucauggaggugaccgccaaguggcugugggacuuccugucccggaacaagaagccccgcaucugcacccgggaggaguucauccgcaaggugcggagcaacgccgccaucggcgccgucuucguggacgagaaccaguggaacagcgcgaaggaggccguggaggacgagcgcuucugggaccucguccaccgggagcgcgagcugcacaagcaggggaagugcgcgaccugcguguacaacaugaugggcaagcgggagaagaagcugggggaguucggcaaggccaagggcucccgcgcgaucugguacauguggcucggggcccgguuccuggaguucgaggcccugggcuucaugaacgaggaccacugguucagccgcgagaacucccucagcgggguggagggcgaggggcugcacaagcugggcuacauccuccgggacaucuccaagaucccgggcgggaacauguacgccgacgacacggccggcugggacacccgcaucaccgaggacgaccugcagaacgaggcgaagaucaccgacaucauggagcccgagcacgcccugcucgccacgagcaucuucaagcugaccuaccagaacaaggucgugcgcgugcagcggcccgccaagaacgggaccgucauggacgugaucucccgccgggaccagcgcggcagcggccagguggggaccuacggccugaacacguucaccaacauggagguccagcucauccggcagauggaguccgaggggaucuuccugcccagcgagcuggagaccaccaaccucgccgagcgcgugcuggacuggcuggagaagcacggcguggagcggcucaagcgcauggcgaucuccggggacgacugcgucgugaagccgaucgacgaccgguucgccacggcccugaucgcccugaacgacaugggcaaggugcgcaaggacaucccccagugggagcccagcaagggcuggaacgacuggcagcagguccccuucugcucccaccacuuccaccagcucaucaugaaggacgggcgggagaucguggugccgugccgcaaccaggacgagcuggucggccgggcccgcgugagccagggggcgggcuggucccugcgggagaccgccugccucggcaagagcuacgcccagauguggcagcugauguacuuccaccgccgggaccugcgccucgccgccaacgcgaucugcuccgccgugcccgucgacugggugcccaccagccggaccacguggagcauccacgcccaccaccaguggaugaccaccgaggacaugcuguccguguggaaccgcgucuggaucgaggagaaccccuggauggaggacaagacccacgugagcuccugggaggaggugccguaccugggcaagcgcgaggaccaguggugcggcagccucaucgggcugaccgcccgggcgacgugggccaccaacauccaggucgccaucaaccaggugcgccggcugaucggcaacgagaacuaccucgacuacaugaccuccaugaagcgcuucaagaacgagagcgaccccgagggggcccugugguga

SEQ ID NO: 8209 - RNA, 9879 nt, Artificial Sequence
  derived and/or modified CDS sequence (opt1) from DENV-1__FJ205875__SS-prME
agcgugaccaugcugcucaugcugcugcccaccgcccucgccuuccaccugaccacccggggcggggagccccacaugaucgugagcaagcaggagcggggcaagagccuccuguucaagaccagcgccgggaucaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcagcgagggcgccuggaagcagauccagaagguggagaccugggcccugcggcaccccggguucacggugaucgcccuguuccucgcgcacgccaucggcaccagcaucacccagaaggggaucaucuucauccugcugaugcucgugacccccuccauggccaugcgcugcgugggcaucggcaaccgggacuucgucgaggggcugagcggcgccacguggguggacgugguccuggagcacggguccugcgugaccaccauggccaaggacaagcccacccucgacaucgagcugcugaagacggaggugaccaaccccgcgauccuccgcaagcugugcaucgaggccaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgcgaagaagcaggagguggugguccugggcucccaggagggcgccaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccgccucaucacggccaacccgaucgugaccgacaaggagaagcccgugaacaucgagaccgagccgcccuucggggagagcuacaucgucgugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccgucgggaagcuggugcaccagguguucggcaccgccuacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcugagcgcggccaucggcaaggccugggaggagggggucugcggcauccgcuccgccacccggcucgagaacaucauguggaagcagaucagcaacgagcugaaccacauccugcucgagaacgacaugaaguucaccgugguggucggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcaucuggcccaagagccacacgcucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcaccacgguggucguggacgagcacugcggcaaccgcgggccgagccuccggaccaccaccgugacgggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggauccugugcgugagcaucaugaucgaggaggugaugcggucccgcuggagcaagaagaugcucaugaccggcacccuggccgucuuccugcuccugaucauggggcagcugacguggaacgaccucauccggcugugcaucauggugggcgccaacgcguccgaccgcauggggaugggcaccaccuaccuggcccucauggccaccuucaagaugcgcccgauguucgccguggggcugcuguuccggcgccucacgagccgggagguccugcugcucaccaucgggcugucccugguggccagcguggagcuccccaacucccuggaggagcugggcgacgggcucgcgaugggcaucaugaugcugaagcugcucaccgaguuccagccccaccagcuguggaccacgcugcucagccugaccuucaucaagaccacccugucccucgacuacgccuggcgcacgauggccaugguccugagcaucgugucccuguucccccucugccugagcaccaccucccagaagaccacguggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgcggggccgcugaucgccggcggcaugcugaucgccugcuacgucaucagcggguccagcgccgaccucucccuggagaaggccgcggaggugagcugggaggaggaggccgagcacuccggcaccagccacaacauccugguggagguccaggacgacgggaccaugaagaucaaggacgaggagcgcgacgacacgcucaccauccugcugaaggccacccuccuggccguguccggcguguaccccaugagcauccccgccacccuguucgucugguacuucuggcagaagaagaagcagcgguccggggugcucugggacacgcccagcccgcccgagguggagcgcgcgguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggagcaccggcgaggaggugcaggucaucgccguggagcccgggaagaacccgaagaacgugcagacgacccccggcaccuucaagacccccgagggcgaggucggggccaucgcgcuggacuucaagcccggcacguccgggagcccgaucgugaaccgggagggcaagaucgugggccuguacgggaacggcgucgugaccaccuccgggaccuacgugagcgccaucgcccaggccaagacgagccaggagggcccccuccccgagaucgaggacgaggucuucaagaagcgcaaccugaccaucauggaccugcacccgggguccggcaagacccggcgcuaccuccccgccaucgugcgggaggcgaucaagcgcaagcugcggacccugauccucgcccccacgcgcguggucgccagcgagauggccgaggcgcugaagggcaugcccauccgcuaccagaccaccgccgugaaguccgagcacaccgggcgggagaucguggaccugaugugccacgccacguucaccaugcgccuccugagcccgguccgggugcccaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccccagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcucucccgcaagacguucgacaccgaguaccagaagaccaagaacaacgacugggacuacguggucaccacggacaucagcgagaugggggccaacuuccgggcggaccgcgugaucgacccccggcgcugccugaagcccgugauccugaaggacggccccgagcgggucauccucgccgggccgaugcccgugaccguggccuccgccgcgcagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcccuguucgagcccgagcgcgagaaguccgccgcgaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccgcucgcccugcgcgaguucaaggaguucgcggccgggcggcgcagcguguccggcgaccugauccucgagaucggcaagcugccccagcaccugacccuccgggcccagaacgcccuggacaaccuggugaugcuccacaacagcgagcagggcgggaaggccuaccgccacgcgauggaggagcugcccgacaccaucgagacgcugaugcuccuggcccugaucgccguccucaccgggggcgugacccuguucuuccuguccgggaagggccucggcaagaccagcaucgggcugcugugcgugauggccuccagcgcgcuccuguggauggccaacgucgagccccacuggaucgccgccuccaucauccuggaguucuuccucauggugcugcugaucccggagcccgaccggcagcgcacgccccaggacaaccagcucgccuacguggucaucggccugcuguucaugauccucaccguggcggccaacgagauggggcugcuggagaccaccaagaaggaccucggcaucgggcacguggccgccgagaaccaccaccacgccacgaugcuggacgucgaccugcggccggcgagcgccuggacccucuacgccguggccaccaccgugaucacgcccaugaugcgccacaccaucgagaacaccaccgccaacaucucccugacggcgaucgccaaccaggccgccauccugaugggccucgacaagggcuggcccaucagcaagauggacaucggggucccccugcuggcccucggcugcuacucccaggugaacccgcugacccugaccgcggccgugcucaugcuggucgcccacuacgccaucaucgggcccggccugcaggcgaaggccacccgggaggcccagaagcgcacggccgccgggaucaugaagaaccccaccguggacggcaucguggcgaucgaccucgaccccgucguguacgacgccaaguucgagaagcagcugggccagaucaugcugcucauccugugcaccagccagauccugcucaugcgcaccacgugggcccugugcgaguccaucacccuggccaccgggccgcucaccacgcugugggagggcagccccgggaaguucuggaacaccaccaucgccguguccauggcgaacaucuuccggggcagcuaccuggccggcgccgggcucgccuucucccugaugaagucccugggcgggggccgccgggggaccggcgcccagggcgagacgcucggggagaaguggaagcgccagcugaaccagcuguccaagagcgaguucaacaccuacaagcggagcggcaucauggaggucgaccgcuccgaggcgaaggaggggcucaagcggggcgagaccaccaagcacgccgugagccgcgggacggccaagcugcgguggcugguggagcgcaaccuggucaagcccgagggcaaggugaucgaccucggcugcgggcggggcgggugguccuacuacugcgccggccugaagaaggugaccgaggucaagggguacaccaagggcggccccgggcacgaggagccgauccccauggcgaccuacggcuggaaccuggugaagcucuacagcgggaaggacguguucuucacgccgcccgagaagugcgacacgcugcugugcgacaucggcgaguccagcccgaaccccaccaucgaggaggggcgcacccuccggguccugaagaugguggagcccuggcugcgcggcaaccaguucugcaucaagauccucaaccccuacaugccguccguggucgagacccuggagcagaugcagcggaagcacggcgggaugcuggugcgcaacccccucagccggaacuccacgcacgagauguacugggugagcugcggcaccgggaacaucgucuccgccgugaacaugaccagccgcaugcugcugaaccgguucaccauggugcaccgcaagcccacguacgagcgcgacgucgaccucggcgccggcacccggcacguggccguggagcccgaggucgccaaccuggacaucaucgggcagcgcaucgagaacaucaagaacgagcacaaguccaccuggcacuacgacgaggacaacccguacaagaccugggcguaccacggcagcuacgaggugaagcccuccgggagcgccuccagcauggugaacggcgucgugcggcugcucacgaagcccugggacgucauccccauggugacccagaucgccaugaccgacaccacgccguucgggcagcagcgcguguucaaggagaaggucgacacccggacgccccgggccaagcggggcaccgcccagaucauggaggugacggcgaaguggcuguggggcuuccugucccgcaacaagaagccccggaucugcacccgcgaggaguucacccggaaggugcgcagcaacgccgccaucggggccgucuucguggacgagaaccaguggaacagcgccaaggaggcgguggaggacgagcgguucugggaccucguccaccgcgagcgggagcugcacaagcagggcaagugcgcgaccugcguguacaacaugauggggaagcgcgagaagaagcugggcgaguucgggaaggccaagggcucccgggccaucugguacauguggcucggcgcgcgcuuccuggaguucgaggcccugggguucaugaacgaggaccacugguucagccgggagaacuccuucagcggcguggagggggacggccuccacaagcugggguacauccugcgcgacaucuccaagaucccgggcggcaacauguacgccgacgacacggccgggugggacacccggaucaccgaggacgaccuccagaacgaggccaagaucaccgacaucauggagcccgagcacgcgcugcuggccacgagcaucuucaagcucaccuaccagaacaaggucgugcgcgugcagcgccccgccaagaacggcaccgucauggacgugaucucccggcgcgaccagcgggggagcggccaggugggcaccuacgggcugaacacguucaccaacauggaggcccagcugauccgccagauggaguccgagggcaucuuccuccccagcgagcuggagaccccgaaccuggccgagcggguccucgacuggcuggagaagcacgggaccgagcgccugaagcggauggcgaucuccggcgacgacugcguggugaagcccgucgacgaccgcuucgccacggcccucaccgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgcgggguggucccugcgcgagaccgccugccugggcaagagcuacgcccagauguggcagcucauguacuuccaccggcgcgaccugcggcuggccgccaacgcgaucugcuccgccgugcccguggacuggguccccaccagccgcaccacguggagcauccacgcccaccaccaguggaugaccaccgaggacaugcucuccguguggaaccggguguggaucgaggagaacccguggauggaggacaagacccacgucagcuccugggaggaggugcccuaccuggggaagcgcgaggaccaguggugcggcagccugaucggccucacggcccgcgcgaccugggccaccaacauccagguggccaucaaccagguccggcgccugaucgggaacgagaacuaccuggacuacaugaccuccaugaagcgguucaagaacgagagcgaccccgagggcgcccucugguga

SEQ ID NO: 8210 - RNA, 9879 nt, Artificial Sequence
  derived and/or modified CDS sequence (opt1) from DENV-1__FJ410173__SS-prME
agcgugaccaugcugcucaugcugcugcccaccgcccucgccuuccaccugaccacccggggcggggagccccacaugaucgucagcaagcaggagcggggcaagagccuccuguucaagaccagcgccgggaucaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccgucgcccuggcgccccacgugggccuggggcucgagacgcgcaccgagaccuggaugagcagcgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugccccacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccaccgagauccagcugaccgacuacggggcccucacgcuggacugcagcccccggaccggccuggacuucaacgagauggugcuccugaccaugaaggagaaguccuggcugguccacaagcagugguuccucgaccugccgcugcccuggaccuccggggccagcacgagccaggagaccuggaaccgccaggaccuccuggugaccuucaagaccgcccacgccaagaagcaggagguggucgugcugggcucccaggagggcgcgaugcacacggcccucaccggggccaccgagauccagaccagcggcacgaccaccaucuucgccgggcaccugaagugccggcugaagauggacaagcucacccugaagggcauguccuacgugaugugcacggggagcuucaagcuggagaaggaggucgccgagacccagcacggcaccgugcuggugcaggucaaguacgagggcaccgacgcgcccugcaagauccccuucuccgcccaggacgagaagggggugacgcagaacggccgccucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcgucuucaccuccguggggaagcuggugcaccaggucuucggcgccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccguggucgugggggacgcgaacggcauccuggcccaggggaagaagaugauccgcccccagcccauggagcaccgguacuccuggaaguccuggggcaaggccaagaucaucggcgccgacauccagaacuccacguucaucaucgacgggcccgacaccccggagugccccgacgaccagcgcgcguggaacaucugggagguggaggacuacggcuucgggaucuucaccaccaacaucuggcugaagcuccgggacagcuacacgcagaugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgucgugguggacgagcacugcggcaaccgggggccgucccuccgcacgaccaccgucaccggcaagaucauccacgaguggugcugccggagcugcacgcugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugaccggcacccuggccguguuccugcuccugaucauggggcagcugaccuggaacgaccucauccgccugugcaucauggugggcgcgaacgccagcgaccggauggggaugggcacgaccuaccuggcccucauggccaccuucaagaugcgcccgauguucgccgucggccugcuguuccggcgccucaccucccgggaggugcugcugcucacgaucgggcugagccugguggcguccgucgagcuccccaacagccuggaggagcugggcgacgggcucgccaugggcaucaugaugcugaagcugcucaccgaguuccagccccaccagcuguggaccacccugcucucccugacguucaucaagaccacccugagccucgacuacgccuggcgcaccauggccauggugcuguccaucgucagccuguucccccucugccuguccacgaccagccagaagaccaccuggcugccggugcuccugggcuccuucgggugcaagccccugacgauguuccucaucaccgagaacaagaucuggggccgcaagagcuggccccugaacgaggggaucauggcgaucggcaucguguccauccugcucagcagccugcugaagaacgacgucccccucgccgggccgcugaucgccggcggcaugcugaucgccugcuacgugaucuccgggagcuccgccgaccucagccuggagaaggcggccgagguguccugggaggaggaggccgagcacagcggcaccucccacaacauccuggucgaggugcaggacgacgggaccaugaagaucaaggacgaggagcgcgacgacacccucacgauccugcugaaggccacccuccuggccgugagcggcgucuaccccauguccauccccgcgaccuucuucgugugguacuucuggcagaagaagaagcagcggagcggggugcugugggacacccccuccccgcccgaggucgagcgcgccgugcucgacgacggcaucuaccggauccugcagcgcggccugcuggggcggagccaggugggcgucgggguguuccaggacggcguguuccacacgauguggcacgucacccgcggggccgugcucauguaccagggcaagcggcuggagcccuccugggccagcgugaagaaggaccugaucuccuacggcgggggcuggcgcuuccaggggagcuggaacaccggcgaggagguccaggugaucgccguggagcccgggaagaacccgaagaacguccagaccacgcccggcaccuucaagacccccgagggcgaggugggggcgaucgcccucgacuucaagcccggcaccuccgggagcccgaucgugaaccgggagggcaagaucgucggccuguacgggaacggcguggugacgaccuccgggaccuacgucagcgccaucgcccaggccaagaccagccaggagggcccccugcccgagaucgaggaggagguguucaagaagcgcaaccucacgaucauggaccugcacccgggguccggcaagacccggcgcuaccugcccgcgaucgugcgggaggccaucaagcgcaagcuccgcacccugauccuggcccccacccgggucguggccagcgagauggcggaggcccucaagggcaugcccauccgcuaccagacgaccgccgugaaguccgagcacaccgggcgggagaucgucgaccugaugugccacgccaccuucacgaugcgccugcucagcccggugcgggugcccaacuacaacaugaucaucauggacgaggcccacuucaccgaccccgcguccaucgccgcccgcggcuacaucagcacccgggucgggaugggcgaggccgccgcgaucuucaugaccgccacgcccccgggguccguggaggccuucccccagagcaacgccgugauccaggacgaggagcgcgacauccccgagcgguccuggaacagcggcuacgacuggaucaccgacuuccccggcaagaccgucugguucgugccguccaucaagagcgggaacgacaucgccaacugccugcgcaagaacggcaagcgggugauccagcugucccgcaagaccuucgacacggaguaccagaagacccggaacaacgacugggacuacgucgugaccaccgacaucagcgagaugggggcgaacuuccgcgccgaccgggugaucgacccccgccggugccucaagcccgucauccugaaggacggccccgagcgcgugauccuggccgggccgaugcccgugacggucgccuccgcggcccagcggcgcggccgcaucggccggaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugcgcggggaggcccggaagaccuucgucgagcugaugcgccggggcgaccuccccguguggcuguccuacaagguggccagcgagggcuuccaguacuccgaccgccgguggugcuucgacggggagcgcaacaaccagguccuggaggagaacauggacguggagaucuggacgaaggagggcgagcggaagaagcuccgcccccgguggcuggacgcccgcaccuacagcgacccgcuggcgcuccgggaguucaaggaguucgccgccgggcgccggagcguguccggcgaccugauccuggagaucggcaagcucccccagcaccugacccugcgcgcccagaacgcccucgacaaccuggucaugcugcacaacagcgagcagggcgggaaggcguaccggcacgccauggaggagcuccccgacaccaucgagacccugaugcugcucgcccugaucgccgugcugaccggcggggugacccucuucuuccuguccgggaaggggcugggcaagaccagcaucgggcuccugugcgucauggcguccagcgcccugcucuggauggccaacguggagccccacuggaucgccgccuccaucauccuggaguucuuccugauggugcuccugaucccggagcccgaccgccagcggacgccccaggacaaccagcuggcguacgucgugaucggccuccuguucaugauccugacgguggccgccaacgagauggggcuccuggagaccaccaagaaggaccugggcaucgggcacgucgccgccgagaaccagcaccacgcgaccaugcucgacguggaccugcgcccggccagcgccuggacgcuguacgccguggccaccaccgucaucacccccaugaugcgccacacgaucgagaacaccaccgcgaacaucucccucaccgccaucgccaaccaggccgccauccugaugggccuggacaagggcuggcccaucagcaagauggacaucggggugccccuccuggcgcugggcugcuacucccaggugaacccgcucacgcugaccgccgccguccugaugcucguggcccacuacgcgaucaucgggcccggccugcaggccaaggccacccgggaggcccagaagcgcaccgccgcggggaucaugaagaaccccacgguggacggcaucgucgccaucgaccuggaccccgugguguacgacgccaaguucgagaagcagcucggccagaucaugcugcugauccucugcaccagccagauccugcugaugcggaccaccugggcccucugcgaguccaucacgcuggccaccgggccgcugaccacccucugggagggcagccccgggaaguucuggaacacgaccaucgcggucuccauggccaacaucuuccgcggcagcuaccuggccggcgccgggcuggccuucucccucaugaagucccugggcgggggccggcgcgggaccggcgcgcagggcgagacccugggggagaaguggaagcggcagcucaaccagcuguccaagagcgaguucaacacguacaagcgcagcggcaucauggagguggaccgguccgaggccaaggaggggcugaagcgcggcgagaccaccaagcacgccgugagccgggggaccgccaagcuccgcugguucgucgagcggaaccuggugaagcccgagggcaaggugaucgaccugggcugcgggcgcggcgggugguccuacuacugcgcgggccugaagaaggucacggaggugaagggguacaccaagggcggccccgggcacgaggagccgauccccauggccaccuacggcuggaaccucgugaagcuguacagcgggaaggacgucuucuucacgccgcccgagaagugcgacacccugcucugcgacaucggcgaguccagcccgaaccccacgaucgaggaggggcggacccugcgcgugcugaagaugguggagcccuggcuccggggcaaccaguucugcaucaagauccugaaccccuacaugccguccgucguggagacccuggagcagaugcagcgcaagcacggcgggaugcucgugcggaacccccugagccgcaacuccacccacgagauguacugggucagcugcggcacggggaacaucguguccgccgugaacaugaccagccgcaugcugcucaaccgguucaccaugacccaccgcaagcccacguacgagcgggacgucgaccugggcgccggcacccgccacguggccguggagcccgaggucgcgaaccuggacaucaucgggcagcggaucgagaacaucaagaacgagcacaaguccaccuggcacuacgacgaggacaacccguacaagaccugggccuaccacggcagcuacgaggugaagcccuccgggagcgccuccagcauggugaacggcgucgugcgccuccugacgaagcccugggacgucauccccauggugacccagaucgccaugaccgacaccacgccguucgggcagcagcggguguucaaggagaaggucgacacccgcacgccccgggccaagcgcggcaccgcgcagaucauggaggugacggccaaguggcuguggggcuuccucucccggaacaagaagccccgcaucugcacccgggaggaguucacccgcaaggugcggagcaacgccgccaucggggccgucuucguggacgagaaccaguggaacagcgcgaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcucccgcgcgaucugguacauguggcugggcgcccgguuccuggaguucgaggcccucggguucaugaacgaggaccacugguucagccgcgagaacuccuucagcggcguggagggggagggccugcacaagcugggguacauccuccgcgacaucuccaagaucccgggcggcaacauguacgccgacgacacggccgggugggacacccggaucaccgaggacgaccugcagaacgaggcgaagaucaccgacaucauggagcccgagcacgcccugcucgccacgagcaucuucaagcugaccuaccagaacaaggucgugcgcgugcagcggcccgccaagaacggcaccgucauggacgugaucucccgccgggaccagcgcgggagcggccaggugggcaccuacgggcugaacacguucaccaacauggagguccagcucauccggcagauggaguccgagggcaucuuccugcccagcgagcuggagaccccgaaccucgccgagcgcgugcugaacuggcuggagaagcacgggaccgagcggcucaagcgcauggcgaucuccggcgacgacugcguggucaagcccguggacgaccgguucgccacggcccugaucgcccugaacgacauggggaaggugcgcaaggacaucccccagugggagcccagcaagggcuggaacgacuggcagcaggucccguucugcucccaccacuuccaccagcucaucaugaaggacggccgggagaucguggugcccugccgcaaccaggacgagcuggucgggcgggcccgcgugagccagggcgcgggguggucccugcgggagaccgccugccucggcaagagcuacgcccagauguggcagcugauguacuuccaccgccgggaccugcgccucgccgccaacgcgaucugcuccgccgugcccgucgacugggugcccaccagccgcaccaccuggagcauccacgcccaccaccaguggaugacgaccgaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgggcgacgugggccaccaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8211 - RNA, 9879 nt, Artificial Sequence
  derived and/or modified CDS sequence (opt1) from DENV-1__FJ410174__SS-prME
agcgugaccaugcugcucaugcugcugcccaccgcccucgccuuccaccugaccacccggggcggggagccccacaugaucgucagcaagcaggagcggggcaagagccugcuguucaagaccagcgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccgucgcccuggcgccccacgugggccuggggcucgagacccggaccgagaccuggaugagcuccgagggcgccuggaagcagauccagaagguggagaccugggcccugcggcacccgggguucacggucaccgcccuguuccucgcgcacgccaucggcaccagcaucacccagaaggggaucaucuucauccugcugaugcucgugacgcccuccauggccaugcggugcgugggcaucggcaaccgggacuucgucgaggggcugagcggcgccaccuggguggacgugguccuggagcacggguccugcgugaccaccaucgccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgcguggaacaucugggagguggaggacuacggcuucgggaucuucaccaccaacaucuggcugaagcuccgggacagcuacacgcagaugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgucgugguggacgagcacugcggcaaccgggggccgucccuccgcacgaccaccgucaccggcaagaucauccacgaguggugcugccggagcugcacgcugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugaccggcacccuggccguguuccugcuccugaucauggggcagcugaccuggaacgaccucauccgccugugcaucauggugggcgcgaacgccagcgaccggauggggaugggcaucacguaccuggcccucauggccaccuucaagaugcgcccgauguucgccgucggccugcuguuccggcgccucaccucccgggaggugcugcugcucaccaucgggcugagccugguggcguccgucgagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgccuggcgcaccauggccauggugcuguccaucgucagccuguucccccucugccuguccaccacgagccagaagaccaccuggcugccggugcuccugggcuccuucgggugcaagccccugaccauguuccucaucacggagaacaagaucuggggccgcaagagcuggccccugaacgaggggaucauggcgaucggcaucguguccauccugcucagcagccugcugaagaacgacgucccccucgccgggccgcugaucgccggcggcaugcugaucgccugcuacgugaucuccgggagcuccgccgaccucagccuggagaaggcggccgagguguccugggaggaggaggccgagcacagcggcaccucccacaacauccuggucgaggugcaggacgacgggaccaugaagaucaaggacgaggagcgcgacgacacccucaccauccugcugaaggccacgcuccuggccgugagcggcgucuaccccauguccauccccgcgacccuguucgugugguacuucuggcagaagaagaagcagcggagcggggugcucugggacacccccuccccgcccgaggucgagcgcgccgugcuggacgacggcaucuaccggauccugcagcgcggccugcucgggcggagccaggugggcgucgggguguuccaggacggcguguuccacaccauguggcacgucacgcgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacccccggcacguucaagacccccgagggcgaggugggggcgaucgcccuggacuucaagcccggcaccuccgggagcccgaucgugaaccgggagggcaagaucgucggccuguacgggaacggcguggugaccacguccgggaccuacgucagcgccaucgcccaggccaagaccagccaggagggcccccuccccgagaucgaggaggagguguucaagaagcgcaaccugaccaucauggaccugcacccgggguccggcaagacgcggcgcuaccuccccgcgaucgugcgggaggccaucaagcgcaagcugcgcacccugauccucgcccccacccgggucguggccagcgagauggcggaggcccugaagggcaugcccauccgcuaccagaccacggccgugaaguccgagcacaccgggcgggagaucgucgaccugaugugccacgccaccuucaccaugcgccuccugagcccggugcgggugcccaacuacaacaugaucaucauggacgaggcccacuucacggaccccgcguccaucgccgcccgcggcuacaucagcacccgggucgggaugggcgaggccgccgcgaucuucaugaccgccacgccgcccggguccguggaggccuucccccagagcaacgccgugauccaggacgaggagcgcgacauccccgagcgguccuggaacagcggcuacgacuggaucacggacuuccccggcaagaccgucugguucgugcccuccaucaagagcgggaacgacaucgccaacugccugcgcaagaacggcaagcgggugauccagcucucccgcaagaccuucgacaccgaguaccagaagacgaagaacaacgacugggacuacgucgugaccaccgacaucagcgagaugggggcgaacuuccgggccgaccgcgugaucgacccccggcgcugccugaagcccgucauccugaaggacggccccgagcgggugauccucgccgggccgaugcccgugaccgucgccuccgcggcccagcgccggggccgcaucggccgcaaccagaacaaggagggggaccaguacguguacaugggccagccccugaacaacgacgaggaccacgcccacuggacggaggccaagaugcugcucgacaacaucaacacccccgaggggaucaucccggcccuguucgagcccgagcgggagaaguccgcggccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggaccaaggagggcgagcgcaagaagcugcggccccgcuggcuggacgcccggacguacagcgacccgcucgcgcugcgcgaguucaaggaguucgccgccgggcggcgcagcguguccggcgaccugauccucgagaucggcaagcugccccagcaccugacccuccgggcccagaacgcccuggacaaccuggucaugcuccacaacagcgagcagggcgggaaggcguaccgccacgccauggaggagcugcccgacaccaucgagacccugaugcuccuggcccugaucgccgugcucaccgggggcgugacgcuguucuuccuguccgggaagggccucggcaagaccagcaucgggcugcugugcgucauggcguccagcgcccuccuguggauggccaacguggagccccacuggaucgccgccuccaucauccuggaguucuuccucauggugcugcugaucccggagcccgaccggcagcgcacgccccaggacaaccagcucgcguacgucgugaucggccugcuguucaugauccucaccguggccgccaacgagauggggcugcuggagacgaccaagaaggaccucggcaucgggcacgucgccgccgagaaccagcaccacgcgaccaugcuggacguggaccugcggccggccagcgccuggacccucuacgccguggccacgaccgucaucacccccaugaugcgccacaccaucgagaacacgaccgcgaacaucucccugaccgccaucgccaaccaggccgccauccugaugggccucgacaagggcuggcccaucagcaagauggacaucggggugccccugcuggcgcucggcugcuacucccaggugaacccgcugacccugacggccgccguccucaugcugguggcccacuacgcgaucaucgggcccggccugcaggccaaggccacccgcgaggcccagaagcggaccgccgcggggaucaugaagaaccccaccguggacggcaucgucgccaucgaccucgaccccgugguguacgacgccaaguucgagaagcagcugggccagaucaugcugcucauccugugcacgagccagauccugcucaugcgcaccaccugggcccugugcgaguccaucacccuggccacggggccgcucaccacccugugggagggcagccccgggaaguucuggaacaccacgaucgcggucuccauggccaacaucuuccggggcagcuaccuggccggcgccgcccucgcguucucccugaugaagucccucgggggcgggcgccgggggaccggggcccagggcgagacccucggcgagaaguggaagcgccagcugaaccagcuguccaagagcgaguucaacaccuacaagcggagcgggaucauggagguggaccgcuccgaggccaaggagggccucaagcgcggggagacgaccaagcacgccgugagccgcggcaccgcgaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcgggcccggccacgaggagccgauccccauggccaccuacggguggaaccuggugaagcuguacagcggcaaggacgucuucuucacgccgcccgagaagugcgacacccuccugugcgacaucggggaguccagcccgaaccccaccaucgaggagggccgcacgcugcgggugcucaagaugguggagcccuggcugcgcgggaaccaguucugcaucaagauccugaaccccuacaugccguccgucguggagacccucgagcagaugcagcggaagcacggcggcaugcuggugcgcaacccccugagccggaacuccacccacgagauguacugggucagcugcgggaccggcaacaucguguccgccgugaacaugacgagccgcaugcuccugaaccgcuucaccaugacccaccggaagcccaccuacgagcgcgacgucgaccugggggccggcacgcggcacguggcgguggagcccgaggucgccaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggugaacggggucgugcggcugcugaccaagcccugggacgucauccccauggugacgcagaucgccaugaccgacaccaccccguucggccagcagcgcguguucaaggagaaggucgacacgcggacgccccgggcgaagcgggggaccgcccagaucauggaggugaccgccaaguggcucuggggcuuccugucccgcaacaagaagccccggaucugcacgcgcgaggaguucacccggaaggugcgcagcaacgccgccaucggcgcggucuucguggacgagaaccaguggaacagcgccaaggaggccguggaggacgagcgguucugggaccugguccaccgcgagcgggagcuccacaagcaggggaagugcgcgaccugcguguacaacaugaugggcaagcgcgagaagaagcugggggaguucggcaaggcgaaggggucccgggccaucugguacauguggcugggcgcccgcuuccucgaguucgaggcccugggcuucaugaacgaggaccacugguucagccgggagaacuccuucagcgggguggagggcgaggggcugcacaagcucggcuacauccugcgcgacaucuccaagauccccgggggcaacauguacgccgacgacaccgcgggcugggacacgcgcaucaccgaggacgaccugcagaacgaggccaagaucaccgacaucauggaggccgagcacgcccuccuggccaccagcaucuucaagcugacguaccagaacaaggucgugcgggugcagcgccccgcgaagaacgggaccgucauggacgugaucucccggcgcgaccagcggggcagcggccagguggggaccuacggccucaacaccuucacgaacauggagguccagcugauccgccagauggaguccgaggggaucuuccugcccagcgagcucgagacccccaaccuggccgagcgggugcuggacuggcucgagaagcacggcaccgagcgccugaagcggauggccaucuccggggacgacugcguggucaagccgguggacgaccgcuucgccaccgcccugaucgcgcucaacgacaugggcaaggugcggaaggacaucccccagugggagcccagcaagggguggaacgacuggcagcagguccccuucugcucccaccacuuccaccagcugaucaugaaggacggccgcgagaucguggugccgugccggaaccaggacgagcuggucggccgcgcccgggugagccagggggccggcuggucccuccgcgagacggccugccugggcaagagcuacgcccagauguggcagcugauguacuuccaccggcgcgaccuccggcuggcggccaacgccaucugcuccgccgugcccgucgacugggugcccaccagccgcaccaccuggagcauccacgcgcaccaccaguggaugaccacggaggacaugcuguccguguggaaccgcgucuggaucgaggagaaccccuggauggaggacaagacccacgugagcuccugggaggaggugccguaccucggcaagcgggaggaccaguggugcgggagccugaucggccugaccgcccgcgccaccugggccacgaacauccaggucgccaucaaccaggugcggcgccucaucggcaacgagaacuaccuggacuacaugaccuccaugaagcgguucaagaacgagagcgaccccgagggggcgcugugguga

SEQ ID NO: 8212 - RNA, 9879 nt, Artificial Sequence
  derived and/or modified CDS sequence (opt1) from DENV-1__FJ410175__SS-prME
agcgugaccaugcugcucaugcugcugcccaccgcccucgccuuccaccugaccacccggggcggggagccccacaugaucgucagcaagcaggagcggggcaagagccuccuguucaagaccagcgccgggaucaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccgucgcccuggcgccccacgugggccuggggcucgagacgcgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugccccacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgcguggaacaucugggagguggaggacuacggcuucgggaucuucaccaccaacaucuggcugaagcuccgggacagcuacacgcagaugugcgaccaccgccugauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgucgugguggacgagcacugcggcaaccgggggccgucccuccgcacgaccaccgucaccggcaagaucauccacgaguggugcugccggagcugcacgcugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugaccggcacccuggccguguuccugcuccugaucauggggcagcugaccuggaacgaccucauccgccugugcaucauggugggcgcgaacgccagcgaccggauggggaugggcacgaccuaccuggcccucauggccaccuucaagaugcgcccgauguucgccgucggccugcuguuccggcgccucaccucccgggaggugcugcugcucacgaucgggcugagccugguggcguccgucgagcuccccaacagccuggaggagcugggcgacgggcucgccaugggcaucaugaugcugaagcugcucaccgaguuccagccccaccagcuguggaccacccugcucucccugacguucaucaagaccacccugagccucgacuacgccuggcgcaccauggccauggugcuguccaucgucagccuguucccccucugccuguccacgaccagccagaagaccaccuggcugccggugcuccugggcuccuucgggugcaagccccugacgauguuccucaucaccgagaacaagaucuggggccgcaagagcuggccccugaacgaggggaucauggcgaucggcaucguguccauccugcucagcagccugcugaagaacgacgucccccucgccgggccgcugaucgccggcggcaugcugaucgccugcuacgugaucuccgggagcuccgccgaccucagccuggagaaggcggccgagguguccugggaggaggaggccgagcacagcggcaccucccacaacauccuggucgaggugcaggacgacgggaccaugaagaucaaggacgaggagcgcgacgacacccucacgauccugcugaaggccacccuccuggccgugagcggcgucuaccccauguccauccccgcgacccuguucgugugguacuucuggcagaagaagaagcagcggagcggggugcucugggacacccccuccccgcccgaggucgagcgcgccgugcuggacgacggcaucuaccggauccugcagcgcggccugcucgggcggagccaggugggcgucgggguguuccaggacggcguguuccacacgauguggcacgucacccgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacgcccggcaccuucaagacccccgagggcgaggugggggcgaucgcccuggacuucaagcccggcaccuccgggagcccgaucgugaaccgggagggcaagaucgucggccuguacgggaacggcguggugacgaccuccgggaccuacgucagcgccaucgcccaggccaagaccagccaggagggcccccuccccgagaucgaggaggagguguucaagaagcgcaaccugacgaucauggaccugcacccgggguccggcaagacccggcgcuaccuccccgcgaucgugcgggaggccaucaagcgcaagcugcgcacccugauccucgcccccacccgggucguggccagcgagauggcggaggcccugaagggcaugcccauccgcuaccagacgaccgccgugaaguccgagcacaccgggcgggagaucgucgaccugaugugccacgccaccuucacgaugcgccuccugagcccggugcgggugcccaacuacaacaugaucaucauggacgaggcccacuucaccgaccccgcguccaucgccgcccgcggcuacaucagcacccgggucgggaugggcgaggccgccgcgaucuucaugaccgccacgcccccgggguccguggaggccuucccccagagcaacgccgugauccaggacgaggagcgcgacauccccgagcgguccuggaacagcggcuacgacuggaucaccgacuuccccggcaagaccgucugguucgugccguccaucaagagcgggaacgacaucgccaacugccugcgcaagaacggcaagcgggugauccagcucucccgcaagaccuucgacacggaguaccagaagaccaagaacaacgacugggacuacgucgugaccaccgacaucagcgagaugggggcgaacuuccgggccgaccgcgugaucgacccccggcgcugccugaagcccgucauccugaaggacggccccgagcgggugauccucgccgggccgaugcccgugacggucgccuccgcggcccagcgccggggccgcaucggccgcaaccagaacaaggagggggaccaguacguguacaugggccagccccugaacaacgacgaggaccacgcccacuggaccgaggccaagaugcugcucgacaacaucaacacccccgaggggaucaucccggcccuguucgagcccgagcgggagaaguccgcggccaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggacgaaggagggcgagcgcaagaagcugcggccccgcuggcuggacgcccggaccuacagcgacccgcucgcgcugcgcgaguucaaggaguucgccgccgggcggcgcagcguguccggcgaccugauccucgagaucggcaagcugccccagcaccugacccuccgggcccagaacgcccuggacaaccuggucaugcuccacaacagcgagcagggcgggaaggcguaccgccacgccauggaggagcugcccgacaccaucgagacccugaugcuccuggcccugaucgccgugcucaccggcggggugacccuguucuuccuguccgggaaggggcucggcaagaccagcaucgggcugcugugcgucauggcguccagcgcccuccuguggauggccaacguggagccccacuggaucgccgccuccaucauccuggaguucuuccucauggugcugcugaucccggagcccgaccggcagcgcacgccccaggacaaccagcucgcguacgucgugaucggccugcuguucaugauccucacgguggccgccaacgagauggggcugcuggagaccaccaagaaggaccucggcaucgggcacgucgccgccgagaaccagcaccacgcgaccaugcuggacguggaccugcggccggccagcgccuggacgcucuacgccguggccaccaccgucaucacccccaugaugcgccacacgaucgagaacaccaccgcgaacaucucccugaccgccaucgccaaccaggccgccauccugaugggccucgacaagggcuggcccaucagcaagauggacaucggggugccccugcuggcgcucggcugcuacucccaggugaacccgcugacgcugaccgccgccguccucaugcugguggcccacuacgcgaucaucgggcccggccugcaggccaaggccacccgcgaggcccagaagcggaccgccgcggggaucaugaagaaccccacgguggacggcaucgucgccaucgaccucgaccccgugguguacgacgccaaguucgagaagcagcugggccagaucaugcugcucauccugugcaccagccagauccugcucaugcgcaccaccugggcccugugcgaguccaucacgcuggccaccgggccgcucaccacccugugggagggcagccccgggaaguucuggaacacgaccaucgcggucuccauggccaacaucuuccggggcagcuaccuggccggcgccgggcucgccuucucccugaugaagucccugggcgggggccgccgggggaccggcgcgcagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgugagccgcgggaccgccaagcugcggugguucgucgagcgcaaccuggugaagcccgagggcaaggugaucgaccugggcugcgggcggggcgggugguccuacuacugcgcgggccucaagaaggucacggaggugaagggguacaccaagggcggccccgggcacgaggagccgauccccauggccaccuacggcuggaaccuggugaagcuguacagcgggaaggacgucuucuucacgccgcccgagaagugcgacacccuccugugcgacaucggcgaguccagcccgaaccccacgaucgaggaggggcgcacccugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcacggggaacaucguguccgccgugaacaugaccagccgcaugcuccugaaccgcuucaccaugacccaccggaagcccacguacgagcgcgacgucgaccugggcgccggcacccggcacguggccguggagcccgaggucgcgaaccucgacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggugaacggcgucgugcggcugcugacgaagcccugggacgucauccccauggugacccagaucgccaugaccgacaccacgccguucgggcagcagcgcguguucaaggagaaggucgacacccggacgccccgggccaagcggggcaccgcgcagaucauggaggugacggccaaguggcucuggggcuuccugucccgcaacaagaagccccggaucugcacccgcgaggaguucacccggaaggugcgcagcaacgccgccaucggggccgucuucguggacgagaaccaguggaacagcgcgaaggaggccguggaggacgagcgguucugggaccugguccaccgcgagcgggagcuccacaagcagggcaagugcgcgaccugcguguacaacaugauggggaagcgcgagaagaagcugggcgaguucgggaaggccaagggcucccgggcgaucugguacauguggcugggcgcccgcuuccucgaguucgaggcccugggguucaugaacgaggaccacugguucagccgggagaacuccuucagcggcguggagggggagggccugcacaagcucggguacauccugcgcgacaucuccaagaucccgggcggcaacauguacgccgacgacacggccgggugggacacccgcaucaccgaggacgaccugcagaacgaggcgcggaucaccgacaucauggagcccgagcacgcccuccuggccacgagcaucuucaagcugaccuaccagaacaaggucgugcgcgugcagcggcccgccaagaacggcaccgucauggacgugaucucccgccgggaccagcgcgggagcggccaggugggcaccuacgggcucaacacguucaccaacauggagguccagcugauccggcagauggaguccgagggcaucuuccugcccagcgagcucgagaccccgaaccuggccgagcgcgugcuggacuggcucgagaagcacgggaccgagcggcugaagcgcauggcgaucuccggcgacgacugcguggucaagcccguggacgaccgguucgccacggcccugaucgcccucaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcuggucgggcgggcccgcgugagccagggcgcgggguggucccuccgggagaccgccugccugggcaagagcuacgcccagauguggcagcugauguacuuccaccgccgggaccuccgccuggccgccaacgcgaucugcuccgccgugcccgucgacugggugcccaccagccgcaccaccuggagcauccacgcccaccaccaguggaugacgaccgaggacaugcuguccguguggaaccgggucuggaucgaggagaacccguggauggaggacaagacccacgugagcuccugggaggaggugcccuaccucgggaagcgcgaggaccaguggugcggcagccugaucggccugaccgcccgggcgacgugggccaccaacauccaggucgccaucaaccaggugcgccggcucaucgggaacgagaacuaccuggacuacaugaccuccaugaagcgcuucaagaacgagagcgaccccgagggcgcccugugguga

SEQ ID NO: 8213 - RNA, 9879 nt, Artificial Sequence
  derived and/or modified CDS sequence (opt1) from DENV-1__FJ562105__SS-prME
agcgugaccaugcugcucaugcugcugcccaccgugcucgccuuccaccugaccacccggggcggggagccccacaugaucgugggcaagcaggagcggggcaagagccuccuguucaagaccagcgccggggugaacaugugcacccugaucgccauggaccugggggagcucugcgaggacaccaugaccuacaagugcccccggaucaccgaggccgagcccgacgacguggacugcuggugcaacgccaccgacaccugggugaccuacgggaccugcucccagaccggcgagcaccggcgggacaagcggagcguggcccuggcgccccacgucgggcugggccucgagacccgcaccgagaccuggauguccagcgagggggccuggaagcagauccagaagguggagaccugggcccugcggcacccgggcuucaccgugaucgccuucuuccuggcccacgcgaucgggaccuccaucacccagaagggcaucaucuucauccuccugaugcuggucacccccagcauggccaugcgcugcgugggcaucgggaaccgggacuucguggagggccucuccggggccacgugggucgacguggugcuggagcacggcagcugcgucaccaccauggccaagaacaagcccacccuggacaucgagcuccugaagacggaggugaccaaccccgccgugcugcgcaagcucugcaucgaggcgaagaucuccaacaccaccacggacagccggugcccgacccagggcgaggccacccuggucgaggagcaggacgccaacuucgugugccgccggaccuucguggaccgcggguggggcaacgggugcggccuguucgggaagggcucccuccugacgugcgccaaguucaagugcgucaccaagcuggagggcaagaucgugcaguacgagaaccucaaguacagcgugaucgucaccgugcacaccggggaccagcaccaggucggcaacgagacgaccgagcacgggaccaucgccaccaucacgccccaggcgcccacguccgagauccagcugaccgacuacggcgcccugacccucgacugcagcccccggaccgggcuggacuucaacgagauggugcugcucacgaugaaggagaaguccuggcuggugcacaagcagugguuccuggaccucccgcugcccuggaccagcggcgccuccaccagccaggagaccuggaaccgccaggaccugcucgucacguucaagaccgcccacgccaagaagcaggagguggugguccugggcagccaggagggggcgaugcacaccgcccugaccggcgccacggagauccagaccuccgggaccaccacgaucuucgccggccaccucaagugccggcugaagauggacaagcugacccucaaggggaugagcuacgugaugugcaccggcuccuucaagcuggagaaggagguggccgagacccagcacggcacgguccugguccaggugaaguacgaggggaccgacgcgcccugcaagaucccccugagcacccaggacgagaagggcgucacccagaacgggcgccucaucacggccaacccgaucgugaccgacaaggagaagcccgugaacaucgagaccgagccgcccuucggcgaguccuacaucaucgucggcgccggggagaaggcccugaagcugagcugguucaagaagggcuccagcaucgggaagauguucgaggcgaccgcccggggcgcccgccggauggccauccucggggacacggccugggacuucggcuccaucggcgggguguucaccagcgugggcaagcugguccaccagguguucgggaccgcguacggcgugcuguucuccggggucagcuggaccaugaagaucggcaucggcauccuccugacguggcuggggcucaacucccgcagcgccucccugagcaugaccugcaucgccgugggcauggugacccuguaccucggggucauggugcaggccgacuccggcugcgugaucaacuggaaggggcgcgagcugaagugcggcagcggcaucuucgucaccaacgaggugcacacguggaccgagcaguacaaguuccaggccgacuccccgaagcggcugagcgcggccaucgggaaggccugggaggagggcgugugcgggguccgcagcgccacccggcucgagaacaucauguggaagcagaucuccaacgagcugaaccacauccugcucgagaacgacaugaaguucaccgugguggucggcgacgccaacgggauccuggcgcagggcaagaagaugauccgcccccagcccauggagcacaaguacagcuggaaguccuggggcaaggccaagaucaucggggccgacauccagaacaccacguucaucaucgacggccccgacaccccggagugccccgacgaccagcgggccuggaacaucugggagguggaggacuacggguucggcaucuucaccaccaacaucuggcugaagcuccgcgacagcuacacgcagaugugcgaccaccggcugauguccgcggccaucaaggacagcaaggccgugcacgccgacaugggcuacuggaucgaguccgagaagaacgagaccuggaagcuggcccgcgcgagcuucaucgaggucaagaccugcaucuggcccaagucccacacccucuggagcaacggggugcuggaguccgagaugaucauccccaagaucuacggcgggccgaucagccagcacaacuaccggcccggcuacuucacgcagaccgccgggcccuggcaccugggcaagcucgagcuggacuucgaccugugcgagggcaccaccguggucguggacgagcacugcgggaaccgcggcccgucccuccggacgaccaccgugaccgggaagaucauccacgaguggugcugccgcagcugcacgcugccgccccugcgguuccgcggcgaggacgggugcugguacggcauggagauccggcccgucaaggagaaggaggagaaccucgugcgcuccauggugagcgccggcuccggggaggucgacagcuucagccugggcauccugugccucuccaucaugaucgaggaggugaugcggagccgcuggucccggaagaugcugaugaccgggacccuggccguguuccuccugcugaucaugggccagcucaccuggaacgaccugauccgccugugcaucauggucggggccaacgcgagcgaccgcaugggcaugggcacgaccuaccucgcccugauggccaccuucaagaugcggccgauguucgccguggggcuccuguuccgccggcugaccucccgcgaggugcugcuccugacgaucggccugagccucgucgccuccguggagcugcccaacagccuggaggagcucggggacggccuggcgaugggcaucaugaugcugaagcuccugaccgaguuccagccccaccagcuguggaccacccuccugucccugacguucaucaagaccacccucagccuggacuacgccuggaagaccauggccaugguccuguccaucgugagccucuucccccugugccuguccacgaccagccagaagaccaccuggcucccggugcugcugggguccuucggcugcaagccccucacgauguuccugaucaccgagaacaagaucugggggcgcaagagcuggccccugaacgagggcaucauggccaucgggaucgucuccauccuccugagcucccugcucaagaacgacgugccccuggcgggcccgcugaucgccggcgggaugcucaucgccugcuacgugaucagcggcagcuccgccgaccugagccuggagaaggccgcggaggucuccugggaggaggaggccgagcacagcgggaccucccacaacauccucguggaggugcaggacgacggcaccaugaagaucaaggacgaggagcgcgacgacacccugacgauccugcucaaggccacccugcuggccgucagcgggguguaccccauguccauccccgccacccucuucgugugguacuucuggcagaagaagaagcagcggagcggcguccugugggacacccccuccccgcccgagguggagcgcgcggugcuggacgacggcaucuaccggauccugcagcgcgggcuccugggccggagccaggucggggugggcguguuccaggacggggucuuccacacgauguggcacgugacccgcggcgccgugcugauguaccagggcaagcggcucgagcccuccugggccagcgucaagaaggaccugaucuccuacgggggcggguggcgcuuccagggcagcuggaacaccggggaggagguccaggugaucgccgucgagcccggcaagaacccgaagaacgugcagaccacgcccggcaccuucaagacccccgagggggaggugggcgccgucgcgcuggacuucaagcccgggaccuccggcagcccgaucgugaaccgggagggcaagaucguggggcucuacggcaacggggucgugacgaccuccggcaccuacgugagcgccaucgcccaggccaaggccucccaggaggggccccugcccgagaucgaggacgaggucuucaagaagcgcaaccugaccaucauggaccuccacccgggcagcggcaagacgcggcgcuaccugcccgcgaucgugcgggaggccaucaagcgcaagcugcggacccucauccuggcccccacccgcguggucgccagcgagauggcggaggcccugaaggggaugcccauccgcuaccagaccacggccgugaaguccgagcacaccggccgggagaucguggaccucaugugccacgccaccuucaccaugcgccugcugagcccgguccgggugcccaacuacaacaugaucaucauggacgaggcccacuucacggaccccgcguccaucgccgcccgcggguacaucagcacccgggugggcaugggggaggccgccgcgaucuucaugaccgccacgccgcccggcuccgucgaggccuucccccagagcaacgccgugauccaggacgaggagcgcgacauccccgagcgguccuggaacagcggcuacgacuggaucacggacuuccccgggaagaccgugugguucguccccuccaucaagagcggcaacgacaucgccaacugccuccgcaagaacgggaagcgggugauccagcugucccgcaagaccuucgacaccgaguaccagaagacgaagaacaacgacugggacuacguggucaccaccgacaucagcgagaugggcgcgaacuuccgggccgaccgcgugaucgacccccggcgcugccugaagcccgugauccucaaggacgggcccgagcgggucauccuggccggcccgaugcccgugaccgucgccuccgcggcccagcgccggggccgcaucgggcggaaccagaacaaggagggcgaccaguacguguacauggggcagccccugaacaacgacgaggaccacgcccacuggacggaggccaagaugcuccuggacaacaucaacacccccgagggcaucaucccggcccuguucgagcccgagcgcgagaaguccgcggccaucgacggggaguaccgccuccggggcgaggcccgcaagaccuucguggagcugaugcggcgcggcgaccugcccgucuggcucuccuacaagguggccagcgagggguuccaguacuccgaccggcgcuggugcuucgacggcgagcggaacaaccaggugcuggaggagaacauggacgucgagaucuggaccaaggagggggagcgcaagaagcugcggccccgcuggcucgacgcccggacguacagcgacccgcuggcgcugcgcgaguucaaggaguucgccgccggccggcgcuccgugagcggcgaccucauccuggagaucgggaagcugccccagcaccucacccugcgggcccagaacgcccuggacaaccucgugaugcugcacaacagcgagcagggcgggaaggcguaccgccacgccauggaggagcugcccgacaccaucgagacccucaugcugcuggcccucaucgccguccugaccggcggggugaugcuguucuuccucuccggcaagggccuggggaagacgagcaucggccugcucugcgugauggcguccagcgcccugcuguggauggccuccgucgagccccacuggaucgccgccagcaucauccucgaguucuuccugauggugcugcucaucccggagcccgaccggcagcgcacgccccaggacaaccagcuggcguacguggucaucgggcuccuguucaugauccugaccguggccgccaacgagaugggccugcucgagaccacgaagaaggaccuggggaucggccacguggccgccgagaaccaccaccacgucaccaugcuggacguggaccuccggccggcguccgccuggacccuguacgccguggccaccacggucaucacccccaugaugcgccacaccaucgagaacaccacggccaacaucagccugaccgcgaucgccaaccaggccgccauccucaugggccuggacaagggguggcccaucuccaagauggacaucggcgugccccugcucgcccuggggugcuacagccaggugaacccgcugacccucaccgcggccguccugaugcugguggcccacuacgccaucaucggccccgggcuccaggcgaaggccacgcgggaggcccagaagcgcaccgccgccggcaucaugaagaaccccaccguggacggcaucgucgcgaucgaccuggaccccgugguguacgacgccaaguucgagaagcagcuggggcagaucaugcuccugauccugugcaccucccagauccuccugaugcgcacgaccugggcccugugcgagagcaucacccucgccaccggcccgcugacgacccugugggaggggucccccggcaaguucuggaacaccaccaucgccgucagcauggcgaacaucuuccggggcuccuaccucgccggggccggccuggccuucagccugaugaagucccucgggggcgggcgccggggcacgggcgcccagggggagacccugggcgagaaguggaagcgccagcugaaccagcucagcaaguccgaguucaacaccuacaagcggagcgggaucauggagguggaccgcagcgaggcgaaggagggccugaagcgcggcgagaccacgaagcacgccgugucccgcggcaccgccaagcugcggugguucgucgagcgcaaccuggugaagcccgagggcaaggugaucgaccucgggugcggccgcggcggguggagcuacuacugcgccgggcugaagaaggucaccgaggugaagggguacaccaagggcgggcccggccacgaggagccgauccccauggcgacguacggguggaaccuggugaagcuccacuccggcaaggacgucuucuucacgccgcccgagaagugcgacacccugcugugcgacaucggggagagcuccccgaaccccaccaucgaggagggccgcacccuccgggugcugaagaugguggagcccuggcugggcgggaaccaguucugcaucaagauccucaaccccuacaugccgagcgucguggagacgcuggagcagaugcagcgcaagcacggcgggaugcuggugcggaacccccucucccgcaacagcacccacgagauguacugggucuccugcggcaccggcaacaucgugagcgccgugaacaugaccucccggaugcugcugaaccgcuucacgauggcccaccggaagcccaccuacgagcgcgacgucgaccucggggccggcacccgccacguggccguggagcccgaggucgcgaaccuggggaucaucggccagcggaucgagaacaucaagaacgagcacaagagcaccuggcacuacgacgaggacaacccguacaagacgugggccuaccacggguccuacgaggugaagcccagcggcuccgccagcuccauggucaacggcguggugcgccugcucaccaagcccugggacgucauccccauggugacccagaucgccaugaccgacacgaccccguucgggcagcagcggguguucaaggagaaggucgacacccgcacgccccgggccaagcgcggcacggcgcagaucauggaggugaccgccaaguggcugugggacuuccugagccggaacaagaagccccgcaucugcacccgggaggaguucauccgcaaggugcgguccaacgccgccaucggggccgucuucguggacgagaaccaguggaacagcgcgaaggaggccguggaggacgagcgcuucugggaccucguccaccgggagcgcgagcugcacaagcagggcaagugcgcgaccugcguguacaacaugauggggaagcgggagaagaagcugggcgaguucggcaaggccaaggggagccgcgcgaucugguacauguggcucggcgcccgguuccuggaguucgaggcccugggguucaugaacgaggaccacugguucucccgcgagaacagccucuccggcguggagggggagggccugcacaagcugggcuacauccuccgggacaucagcaagauccccgggggcaacauguacgccgacgacacggccgggugggacacccgcaucaccgaggacgaccugcagaacgaggcgaagaucaccgacaucauggagcccgagcacgcccugcucgccacguccaucuucaagcugaccuaccagaacaaggucgugcgggugcagcgccccgccaagaacggcaccgucauggacgugaucagccgccgggaccagcgcggcuccggccaggugggcaccuacgggcugaacacguucaccaacauggagguccagcucauccggcagauggagagcgagggcaucuuccugcccuccgagcuggagaccaccaaccucgccgagcgcgugcuggacuggcuggagaagcacgggguggagcggcucaagcgcauggcgaucagcggcgacgacugcgucgugaagccgaucgacgaccgguucgccacggcccugaucgcccugaacgacaugggcaaggugcgcaaggacaucccccagugggagcccuccaagggguggaacgacuggcagcagguccccuucugcagccaccacuuccaccagcucaucaugaaggacggccgggagaucguggugccgugccgcaaccaggacgagcuggucgggcgggcccgcgugucccagggcgcgggguggagccugcgggagaccgccugccucggcaaguccuacgcccagauguggcagcugauguacuuccaccgccgggaccugcgccucgccgccaacgcgaucugcagcgccgugcccgucgacugggugcccaccucccggaccacguggagcauccacgcccaccaccaguggaugaccaccgaggacaugcugagcguguggaaccgcgucuggaucgaggagaaccccuggauggaggacaagacccacguguccagcugggaggaggugccguaccugggcaagcgggaggaccaguggugcgggucccucaucggccugaccgcccgcgcgacgugggccaccaacauccaggucgccaucaaccaggugcgccggcugaucgggaacgagaacuaccucgacuacaugaccagcaugaagcgcuucaagaacgaguccgaccccgagggcgcccugugguga

SEQ ID NO: 8214 - RNA, 9879 nt, Artificial Sequence
  derived and/or modified CDS sequence (opt1) from DENV-1__FJ562106__SS-prME
agcgugaccaugcugcucaugcugcugcccaccgcccucgccuuccaccugaccacccggggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacccggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucauggugggcgccggcgagaaggcgcugaagcuguccugguucaagaaggggagcuccaucggcaagauguucgaggccaccgcccgcggggcgcgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccgccagccuguccaugaccugcaucgccgucgggauggugacccuguaccucggcgugaugguccaggccgacagcgggugcgugaucaacuggaagggccgcgagcugaagugcggguccggcaucuucgugaccaacgagguccacacguggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccguggucgugggggacgcgaacggcauccuggcccaggggaagaagaugauccgcccccagcccauggagcacaaguacuccuggaaguccuggggcaaggccaagaucaucggcgccgacauccagaacaccacguucaucaucgacgggcccgacaccccggagugccccgacgaccagcgggcguggaacaucugggagguggaggacuacggcuucgggaucuucaccaccaacaucuggcugaagcuccgcgacuccuacacgcagaugugcgaccaccggcugaugagcgccgccaucaagaacuccaaggccguccacgccgacaugggcuacuggaucgagagcgagaagaacgagaccuggaagcuggcgcgcgccuccuucaucgaggugaagaccugcaucuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucggccugugcgagggcaccaccgucgugguggacgagcacugcgggaaccgcggcccgagccuccggacgaccaccgucaccgggaagaucauccacgaguggugcugccgcuccugcacgcugccgccccugcgguuccgcggcgaggacgggugcugguacggcauggagauccggcccgugaaggagaaggaggagaaccucgugcgcagcauggucuccgccggcagcggggagguggacagcuucucccugggcauccugugcgugagcaucaugaucgaggaggucaugcggucccgcuggagccggaagaugcucaugaccgggacccuggccguguuccugcuccugaucaugggccagcugaccuggaacgaccucauccgccugugcaucauggugggggcgaacgccuccgaccgcaugggcaugggcacgaccuaccuggcccucauggccaccuucaagaugcggccgauguucgccgucgggcugcuguuccgccggcucaccagccgcgaggugcugcugcucacgaucggccugucccugguggcgagcgucgagcuccccaacucccuggaggagcugggggacggccucgccaugggcaucaugaugcugaagcugcucaccgaguuccagccccaccagcuguggaccacccugcucagccugacguucaucaagaccaccuucucccuggacuacgccuggaagaccauggccauggugcucagcaucgucucccuguucccccugugccucagcacgaccucccagaagaccaccuggcugccggugcugcucgggagcuucggcugcaagccccugacgauguuccugaucaccgagaacaagaucugggggcggaaguccuggccccucaacgagggcaucauggcgaucgggaucgugagcauccugcuguccagccuccugaagaacgacgucccccuggccggcccgcucaucgccggcgggaugcugaucgccugcuacgugaucagcggcuccagcgccgaccugucccucgagaaggcggccgaggugagcugggaggaggaggccgagcacuccgggaccagccacaacauccuggucgaggugcaggacgacggcaccaugaagaucaaggacgaggagcgcgacgacacccugacgauccuccugaaggccacccugcucgccguguccggggucuaccccaugagcauccccgcgacccuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacacgauguggcacgucacccgcggcgccgugcucauguaccagggcaagcggcuggagcccagcugggccuccgugaagaaggaccugaucagcuacgggggcggguggcgcuuccagggcuccuggaacaccggggaggagguccaggugaucgccguggagcccggcaagaacccgaagaacguccagaccacgcccggcaccuucaagacccccgagggggaggugggcgcgaucgcccucgacuucaagcccgggaccagcggcuccccgaucgugaaccgggagggcaagaucgucgggcuguacggcaacgggguggugacgaccagcggcaccuacgucuccgccaucgcccaggccaaggcgagccaggaggggccccugcccgagaucgaggacgagguguucaagaagcgcaaccucaccaucauggaccugcacccgggcagcggcaagacgcggcgcuaccugcccgccaucgugcgggaggccaucaagcgcaagcuccggacccugauccuggcccccacccgcgucguggcguccgagauggccgaggcccucaaggggaugcccauccgcuaccagaccacggccgucaagagcgagcacaccggccgggagaucgucgaccugaugugccacgccaccuucaccaugcgccugcucuccccggugcgggugcccaacuacaacaugaucaucauggacgaggcgcacuucacggaccccgccagcaucgccgcccgcggguacaucuccacccgggucggcaugggggaggccgcggccaucuucaugaccgccacgccgcccggcagcguggaggccuucccccaguccaacgccgugauccaggacgaggagcgcgacauccccgagcggagcuggaacuccggcuacgacuggaucacggacuuccccgggaagaccgucugguucgugcccagcaucaaguccggcaacgacaucgcgaacugccugcgcaagaacgggaagcgggugauccagcugagccgcaagaccuucgacaccgaguaccagaagacgaagaacaacgacugggacuacgucgugaccaccgacaucuccgagaugggcgccaacuuccgggccgaccgcgugaucgacccccggcgcugccucaagcccgucauccugaaggacgggcccgagcgggugauccuggccggcccgaugcccgugaccgucgcgagcgccgcccagcgccggggccgcaucgggcggaaccagaacaaggagggcgaccaguacguguacauggggcagccccucaacaacgacgaggaccacgcccacuggacggaggccaagaugcugcuggacaacaucaacacccccgagggcaucaucccggcccucuucgagcccgagcgcgagaaguccgccgccaucgacggggaguaccgccugcggggcgaggcccgcaagaccuucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggacguacuccgacccgcuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacccugaugcugcucgcccugaucgcggugcugaccggcggggugacccucuucuuccugagcggcaagggccuggggaagaccuccaucggccuccugugcgucauggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagacgaccaagaaggaccuggggaucggccacgucgccgcggagaaccaccaccacgccaccaugcucgacguggaccugcggccggccagcgccuggacccuguacgccguggcgacgaccgucaucacccccaugaugcgccacaccaucgagaacacgaccgccaacaucucccucaccgccaucgccaaccaggccgcgauccugaugggccuggacaagggguggcccaucagcaagauggacaucggcgugccccuccuggcccuggggugcuacucccaggugaacccgcucacccugacggccgccguccugaugcucguggcgcacuacgccaucaucggccccgggcugcaggccaaggccacccgggaggcccagaagcgcaccgcggccggcaucaugaagaaccccaccguggacggcaucgucgccaucgaccuggaccccgugguguacgacgccaaguucgagaagcagcucgggcagaucaugcugcugauccucugcacgagccagauccugcugaugcgcaccaccugggcccucugcgaguccaucacccuggcgacgggcccgcugaccacccucugggaggggagccccggcaaguucuggaacaccacgaucgccgucuccauggccaacaucuuccggggcagcuaccuggccggggccggccuggcguucucccucaugaagucccucgggggcgggcgccgggggaccggcgcccagggggagacccugggcgagaaguggaagcgccagcucaaccagcuguccaagagcgaguucaacaccuacaagcggagcgggaucauggagguggaccgcuccgaggccaaggagggccugaagcgcggggagacgaccaagcacgccgugagccgcggcaccgcgaagcuccggugguucgucgagcgcaaccuggugaagcccgagggcaaggugaucgaccuggggugcggccgcgggggcugguccuacuacugcgccgggcugaagaaggucaccgaggugaagggcuacacgaagggcgggcccggccacgaggagccgauccccauggccaccuacggguggaaccucgugaagcugcacagcggcaaggacgucuucuucacgccgcccgagaagugcgacacccugcucugcgacaucggggaguccagcccgaaccccaccaucgaggagggccgcacgcugcgggugcugaagaugguggagcccuggcuccgcggcaaccaguucugcaucaagauccugaaccccuacaugccguccgucguggagacccuggagcagaugcagcggaagcacgggggcaugcucgugcgcaacccccugagccggaacuccacccacgagauguacugggucagcugcgggaccggcaacaucguguccgccgugaacaugacgagccgcaugcugcucaaccgguucaccauggcccaccgcaagcccaccuacgagcgcgacgucgaccugggcgcggggacccggcacguggccguggagcccgaggucgccaaccuggacaucaucggccagcgcaucgagaacaucaagaacgagcacaaguccacguggcacuacgacgaggacaacccguacaagaccugggccuaccacgggagcuacgaggugaagcccuccggcagcgccuccagcauggugaacggggucgugcggcuccugaccaagcccugggacgucauccccauggugacccagaucgcgaugacggacaccaccccguucggccagcagcgcguguucaaggagaaggucgacacccggacgccccgcgccaagcggggcaccgcccagaucauggaggugaccgccaaguggcuguggggguuccucucccgcaacaagaagccccggaucugcacccgcgaggaguucacgcggaaggugcgcagcaacgccgcgaucggcgccgucuucguggacgagaaccaguggaacagcgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggccaagggcucccgggccaucugguacauguggcugggggcccgcuuccuggaguucgaggcccucggcuucaugaacgaggaccacugguucagccgggagaacucccugagcgggguggagggcgaggggcugcacaagcucggcuacauccugcgcgacaucuccaagaucccgggcgggaacauguacgcggacgacaccgccggcugggacacccggaucacggaggacgaccugcagaacgaggccaagaucaccgacaucauggagcccgagcacgcccuccuggccaccagcaucuucaagcugaccuaccagaacaaggucgugcgcgugcagcgccccgcgaagaacgggacggucauggacgugaucucccggcgcgaccagcggggcagcggccagguggggaccuacggccucaacaccuucaccaacauggagguccagcugauccgccagauggaguccgaggggaucuuccugcccugcgagcucgagacgccgaaccuggccgagcgggugcuggacuggcucgagaagcacggcgccgagcgccugaagcggauggccaucagcggggacgacugcguggucaagcccaucgacgaccgcuucgccaccgcgcugaucgcccucaacgacaugggcaaggugcggaaggacaucccccagugggagcccuccaagggcuggaacgacuggcagcaggucccguucugcagccaccacuuccaccagcugaucaugaaggacgggcgcgagaucgucgugcccugccggaaccaggacgagcuggugggccgcgcccgggucucccagggggccggcuggagccuccgcgagaccgccugccuggggaaguccuacgcgcagauguggcagcugauguacuuccaccggcgcgaccuccggcuggccgccaacgccaucugcagcgcggugcccguggacuggguccccaccucccgcacgaccuggagcauccacgcccaccaccaguggaugaccaccgaggacaugcugagcguguggaaccggguguggaucgaggagaacccguggauggaggacaagacccacgucuccagcugggaggaggugcccuaccucggcaagcgcgaggaccaguggugcggcucccugaucgggcugacgacccgcgccaccugggccaccaacauccagguggccaucaaccagguccggcgccucaucggcaacgagaacuaccuggacuacaugacgagcaugaagcgguucaagaacgaguccgaccccgagggggcgcugugguga

SEQ ID NO: 8215 - RNA, 9879 nt, Artificial Sequence
  derived and/or modified CDS sequence (opt1) from DENV-1__FJ410179__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggugaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagauguacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggccguguuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccgucgggcugcuguuccggcgccucaccagccgggaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcgcaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgcgacgacacccucaccauccugcugaaggccacgcuccuggccaucuccggcguguaccccaugagcauccccgcgacccuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacgcgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacccccggcacguucaagacccccgagggcgaggucggggcgaucgcccuggacuucaagcccggcaccagcggguccccgaucgugaaccgggagggcaagaucgugggccuguacgggaacggcgucgugaccacgagcgggaccuacgugagcgccaucgcccaggccaagaccucccaggagggcccccuccccgagaucgaggaggaggucuucaagaagcgcaaccugaccaucauggaccugcacccggggagcggcaagacgcggcgcuaccuccccgcgaucgugcgggaggccaucaagcgcaagcugcgcacccugauccucgcccccacccggguggucgccuccgagauggcggaggcccugaagggcaugcccauccgcuaccagaccacggccgucaagagcgagcacaccgggcgggagaucguggaccugaugugccacgccaccuucaccaugcgccuccuguccccgguccgggugcccaacuacaacaugaucaucauggacgaggcccacuucacggaccccgcgagcaucgccgcccgcggcuacaucuccacccggguggggaugggcgaggccgccgcgaucuucaugaccgccacgccgcccgggagcgucgaggccuucccccaguccaacgccgugauccaggacgaggagcgcgacauccccgagcggagcuggaacuccggcuacgacuggaucacggacuuccccggcaagaccgugugguucguccccagcaucaaguccgggaacgacaucgccaacugccugcgcaagaacggcaagcgggugauccagcucagccgcaagaccuucgacaccgaguaccagaagacgcggaacaacgacugggacuacguggucaccaccgacaucuccgagaugggggcgaacuuccgcgccgaccgggugaucgacccccgccggugccugaagcccgugauccugaaggacggccccgagcgcgucauccucgccgggccgaugcccgugaccguggccagcgcggcccagcggcgcggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccggcugcgcggggaggcccggaagaccuucguggagcucaugcgccggggcgaccugcccgucuggcugagcuacaagguggccuccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcccgcacguacagcgacccgcucgcgcugcgggaguucaaggaguucgccgccgggcgccgguccgugagcggcgaccugauccucgagaucggcaagcugccccagcaccugacccuccgcgcccagaacgcccuggacaaccuggugaugcuccacaacuccgagcagggcgggaaggcguaccggcacgccauggaggagcugcccgacaccaucgagacccugaugcuccuggcccugaucgccguccucaccgggggcgugacgcuguucuuccugagcgggaagggccucggcaagaccuccaucgggcugcugugcgugauggcgagcuccgcccuccuguggauggccaacgucgagccccacuggaucgccgccagcaucauccuggaguucuuccucauggugcugcugaucccggagcccgaccgccagcggacgccccaggacaaccagcucgcguacguggucaucggccugcuguucaugauccucaccguggccgccaacgagauggggcugcuggagacgaccaagaaggaccucggcaucgggcacguggccgccgagaaccagcaccacgcgaccaugcuggacgucgaccugcgcccggccuccgccuggacccucuacgccguggccacgaccgugaucacccccaugaugcgccacaccaucgagaacacgaccgcgaacaucagccugaccgccaucgccaaccaggccgccauccugaugggccucgacaagggcuggcccaucuccaagauggacaucggggucccccugcuggcgcucggcugcuacagccaggugaacccgcugacccugacggccgccgugcucaugcuggucgcccacuacgcgaucaucgggcccggccugcaggccaaggccacccgggaggcccagaagcgcaccgccgcggggaucaugaagaaccccaccguggacggcaucguggccaucgaccucgaccccgucguguacgacgccaaguucgagaagcagcugggccagaucaugcugcucauccugugcacgucccagauccugcucaugcggaccaccugggcccugugcgagagcaucacccuggccacggggccgcucaccacccugugggagggcucccccgggaaguucuggaacaccacgaucgcggugagcauggccaacaucuuccgcggcuccuaccuggccggcgccgggcucgccuucagccugaugaagucccugggcgggggccggcgcgggaccggcgcgcagggcgagacccucggggagaaguggaagcggcagcugaaccagcugagcaagagcgaguucaacaccuacaagcgcuccggcaucauggaggucgaccggagcgaggccaaggaggggcucaagcgcggcgagacgaccaagcacgccgugucccgggggaccgccaagcugcgcugguucguggagcggaaccuggucaagcccgagggcaaggugaucgaccugggcugcgggcgcggcggguggagcuacuacugcgcgggccucaagaaggugaccgaggucaagggguacacgaagggcggccccgggcacgaggagccgauccccauggccaccuacggcuggaaccuggugaagcuguacuccgggaaggacguguucuucacgccgcccgagaagugcgacacccuccugugcgacaucggcgagagcuccccgaaccccaccaucgaggaggggcggacgcugcgcguccucaagaugguggagcccuggcugcggggcaaccaguucugcaucaagauccugaaccccuacaugccgagcguggucgagacccucgagcagaugcagcgcaagcacggcgggaugcuggugcggaacccccugucccgcaacagcacccacgagauguacuggguguccugcggcaccgggaacaucgucagcgccgugaacaugacgucccgcaugcuccugaaccgguucaccaugacccaccgcaagcccaccuacgagcgggacguggaccugggcgccggcacgcgccacgucgccguggagcccgagguggcgaaccucgacaucaucgggcagcggaucgagaacaucaagaacgagcacaagagcaccuggcacuacgacgaggacaacccguacaagaccugggccuaccacggcuccuacgaggucaagcccagcggguccgccagcuccauggugaacggcgugguccgccugcugaccaagcccugggacgugauccccauggucacgcagaucgccaugaccgacaccaccccguucgggcagcagcggguguucaaggagaagguggacacgcgcacgccccgggccaagcgcggcaccgcgcagaucauggaggucaccgccaaguggcucuggggcuuccugagccggaacaagaagccccgcaucugcacgcgggaggaguucacccgcaaggugcggagcaacgccgccaucggggccguguucgucgacgagaaccaguggaacuccgcgaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagcuucuccggcguggagggggagggccugcacaagcucggguacauccugcgcgacaucagcaagaucccgggcggcaacauguacgccgacgacaccgccgggugggacacgcggaucaccgaggacgaccugcagaacgaggcgaagaucaccgacaucauggagcccgagcacgcccuccuggccaccuccaucuucaagcugacguaccagaacaaggugguccgcgugcagcggcccgccaagaacggcaccgugauggacgucaucagccgccgggaccagcgcggguccggccaggugggcaccuacgggcucaacaccuucacgaacauggaggugcagcugauccggcagauggagagcgagggcaucuuccugcccuccgagcucgagaccccgaaccuggccgagcgcguccuggacuggcucgagaagcacgggaccgagcggcugaagcgcauggcgaucagcggcgacgacugcguggugaagcccgucgacgaccgguucgccaccgcccugaucgcccucaacgacauggggaaggugcgcaaggacaucccccagugggagcccuccaagggcuggaacgacuggcagcaggucccguucugcagccaccacuuccaccagcugaucaugaaggacggccgggagaucgucgugcccugccgcaaccaggacgagcugguggggcgggcccgcgucucccagggcgcgggguggagccuccgggagacggccugccugggcaaguccuacgcccagauguggcagcugauguacuuccaccgccgggaccuccgccuggccgccaacgcgaucugcagcgccgugcccguggacuggguccccaccagccgcaccaccugguccauccacgcccaccaccaguggaugaccacggaggacaugcugagcguguggaaccggguguggaucgaggagaacccguggauggaggacaagacccacgucuccagcugggaggaggugcccuaccucgggaagcgcgaggaccaguggugcggcucccugaucggccugaccgcccgggcgaccugggccacgaacauccagguggccaucaaccagguccgccggcucaucgggaacgagaacuaccuggacuacaugaccagcaugaagcgcuucaagaacgaguccgaccccgagggcgcccugugguga

SEQ ID NO: 8216 - RNA, 9879 nt, Artificial Sequence
  derived and/or modified CDS sequence (opt1) from DENV-1__FJ410181__SS-prME
agcgugaccaugcugcucaugcugcugcccaccgcccucgccuuccaccugaccacccggggcggggagccccacaugaucgucagcaagcaggagcggggcaagagccuccuguucaagaccagcguggggaucaacaugugcacccugaucgccauggaccugggcgagcucugcgaggacaccaugaccuacaagugcccccggaucaccgaggccgagcccgacgacguggacugcuggugcaacgccaccgacacgugggucaccuacgggaccugcagccagaccggcgagcaccggcgggacaagcgguccguggcccuggcgccccacgugggccuggggcucgagacgcgcaccgagaccuggaugagcuccgagggcgccuggaagcagauccagaaggucgagaccugggcccugcggcaccccggguucacggugaccgcccuguuccucgcccacgcgaucggcaccagcaucacccagaaggggaucaucuucauccugcugaugcucgugacgcccuccauggccaugcgcugcgucggcaucggcaaccgggacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccgcaagcugugcaucgaggcgaagaucagcaacaccacgaccgacucccggugccccacccagggcgaggccacccugguggaggagcaggacagcaacuucgucugccgccggacguucguggaccgcggcugggggaacggcugcggccucuucggcaaggggucccugcugaccugcgccaaguucaagugcgugaccaagcucgagggcaagaucguccaguacgagaaccugaaguacagcgugaucgugaccguccacacgggcgaccagcaccagguggggaacgagaccaccgagcacggcaccaucgccaccaucacgccccaggcccccaccuccgagauccagcugaccgacuacggggcgcucacccuggacugcagcccccggacgggccuggacuucaacgagaugguccuccugaccaugaaggagaaguccuggcuggugcacaagcagugguuccucgaccugccgcugcccuggaccagcggggccagcaccucccaggagacguggaaccgccaggaccuccuggugaccuucaagaccgcccacgccaagaagcaggaggucguggugcugggcagccaggagggcgccaugcacaccgcgcucacgggggccaccgagauccagaccuccggcaccacgaccaucuucgccgggcaccugaagugccggcugaagauggacaagcucacccugaagggcaugagcuacgucaugugcaccggguccuucaagcuggagaaggagguggccgagacgcagcacggcaccgugcugguccaggugaaguacgagggcaccgacgcccccugcaagauccccuucagcgcgcaggacgagaagggggugacccagaacggccgccucaucacggccaacccgaucgucaccgacaaggagaagcccgugaacaucgagaccgagccgcccuucggggaguccuacaucgugaucggcgccggcgagaaggcccugaagcugagcugguucaagaagggguccagcaucggcaagauguucgaggcgaccgcccgcggggcccgccggauggccauccucggcgacacggccugggacuucggguccaucggcggcgucuucaccagcguggggaagcuggugcaccaggucuucggcgcggccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucaccguggucgugggggacgccaacggcauccuggcgcaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgccuggaacaucugggagguggaggacuacggcuucgggaucuucaccaccaacaucuggcugaagcuccgggacagcuacacgcagaugugcgaccaccgccugauguccgcggccaucaaggacagcaaggccguccacgccgacaugggcuacuggaucgaguccgagaagaacgagaccuggaagcuggcccgggcgagcuucaucgaggugaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgucgugguggacgagcacugcggcaaccgggggccgucccuccgcacgaccaccgucaccggcaagaucauccacgaguggugcugccggagcugcacgcugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugaccggcacccuggccguguuccugcuccugaucauggggcagcugaccuggaacgaccucauccgccugugcaucauggugggcgccaacgcgagcgaccggauggggaugggcacgaccuaccuggcccucauggccaccuucaagaugcgcccgauguucgccgucggccugcuguuccggcgccucaccucccgggaggugcugcugcucacgaucgggcugagccugguggccuccgucgagcuccccaacagccuggaggagcugggcgacgggcucgcgaugggcaucaugaugcugaagcugcucaccgaguuccagccccaccagcuguggaccacccugcucucccugacguucaucaagaccacccugagccucgacuacgccuggcgcaccauggccauggugcuguccaucgucagccuguucccccucugccuguccacgaccagccagaagaccaccuggcugccggugcuccugggcuccuucgggugcaagccccugacgauguuccucaucaccgagaacaagaucuggggccgcaagagcuggccccugaacgaggggaucauggccaucggcaucguguccauccugcucagcagccugcugaagaacgacgucccccucgcggggccgcugaucgccggcggcaugcugaucgccugcuacgugaucuccgggagcuccgccgaccucagccuggagaaggccgcggagguguccugggaggaggaggccgagcacagcggcaccucccacaacauccuggucgaggugcaggacgacgggaccaugaagaucaaggacgaggagcgcgacgacacccucacgauccugcugaaggccacccuccuggccgugagcggcgucuaccccauguccauccccgccacccuguucgugugguacuucuggcagaagaagaagcagcggagcggggugcucugggacacccccuccccgcccgaggucgagcgcgcggugcuggacgacggcaucuaccggauccugcagcgcggccugcucgggcggagccaggugggcgucgggguguuccaggacggcguguuccacacgauguggcacgucacccgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacgcccggcaccuucaagacccccgagggcgaggugggggccaucgcgcuggacuucaagcccggcaccuccgggagcccgaucgugaaccgggagggcaagaucgucggccuguacgggaacggcguggugacgaccuccgggaccuacgucagcgccaucgcccaggccaagaccagccaggagggcccccuccccgagaucgaggacgagguguucaagaagcgcaaccugacgaucauggaccugcacccgggguccggcaagacccggcgcuaccuccccgccaucgugcgggaggcgaucaagcgcaagcugcgcacccugauccucgcccccacccgggucguggccagcgagauggccgaggcgcugaagggcaugcccauccgcuaccagacgaccgccgugaaguccgagcacaccgggcgggagaucgucgaccugaugugccacgccaccuucacgaugcgccuccugagcccggugcgggugcccaacuacaacaugaucaucauggacgaggcccacuucaccgaccccgccuccaucgcggcccgcggcuacaucagcacccgggucgggaugggcgaggccgccgccaucuucaugaccgcgacgcccccgggguccguggaggccuucccccagagcaacgccgugauccaggacgaggagcgcgacauccccgagcgguccuggaacagcggcuacgacuggaucaccgacuuccccggcaagaccgucugguucgugccguccaucaagagcgggaacgacaucgccaacugccugcgcaagaacggcaagcgggugauccagcucucccgcaagaccuucgacacggaguaccagaagaccaagaacaacgacugggacuacgucgugaccaccgacaucagcgagaugggggccaacuuccgggcggaccgcgugaucgacccccggcgcugccugaagcccgucauccugaaggacggccccgagcgggugauccucgccgggccgaugcccgugacggucgccuccgccgcgcagcgccggggccgcaucggccgcaaccagaacaaggagggggaccaguacguguacaugggccagccccugaacaacgacgaggaccacgcccacuggaccgaggccaagaugcugcucgacaacaucaacacccccgaggggaucaucccggcccuguucgagcccgagcgggagaaguccgccgcgaucgacggcgaguaccgccugcgcggggaggcccgcaagaccuucgucgagcucaugcggcgcggcgaccugcccguguggcuguccuacaagguggccagcgagggcuuccaguacuccgaccggcgcuggugcuucgacggggagcggaacaaccagguccucgaggagaacauggacguggagaucuggacgaaggagggcgagcgcaagaagcugcggccccgcuggcuggacgcccggaccuacagcgacccgcucgcccugcgcgaguucaaggaguucgcggccgggcggcgcagcguguccggcgaccugauccucgagaucggcaagcugccccagcaccugacccuccgggcccagaacgcccuggacaaccuggucaugcuccacaacagcgagcagggcgggaaggccuaccgccacgcgauggaggagcugcccgacaccaucgagacccugaugcuccuggcccugaucgccgugcucaccggcggggugacccuguucuuccuguccgggaaggggcucggcaagaccagcaucgggcugcugugcgucauggccuccagcgcgcuccuguggauggccaacguggagccccacuggaucgccgccuccaucauccuggaguucuuccucauggugcugcugaucccggagcccgaccggcagcgcacgccccaggacaaccagcucgccuacgucgugaucggccugcuguucaugauccucacgguggcggccaacgagauggggcugcuggagaccaccaagaaggaccucggcaucgggcacgucgccgccgagaaccagcaccacgccaccaugcuggacguggaccugcggccggcgagcgccuggacgcucuacgccguggccaccaccgucaucacccccaugaugcgccacacgaucgagaacaccaccgccaacaucucccugaccgcgaucgccaaccaggccgccauccugaugggccucgacaagggcuggcccaucagcaagauggacaucggggugccccugcuggcccucggcugcuacucccaggugaacccgcugacgcugaccgcggccguccucaugcugguggcccacuacgccaucaucgggcccggccugcaggcgaaggccacccgcgaggcccagaagcggaccgccgccgggaucaugaagaaccccacgguggacggcaucgucgcgaucgaccucgaccccgugguguacgacgccaaguucgagaagcagcugggccagaucaugcugcucauccugugcaccagccagauccugcucaugcgcaccaccugggcccugugcgaguccaucacgcuggccaccgggccgcucaccacccugugggagggcagccccgggaaguucuggaacacgaccaucgccgucuccauggcgaacaucuuccggggcagcuaccuggccggcgccgggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggcgaaggaggggcucaagcggggcgagaccaccaagcacgccgugagccgcgggaccgccaagcugcggugguucgucgagcgcaaccuggugaagcccgagggcaaggugaucgaccugggcugcgggcggggcgggugguccuacuacugcgccggccucaagaaggucacggaggugaagggguacaccaagggcggccccgggcacgaggagccgauccccauggcgaccuacggcuggaaccuggugaagcuguacagcgggaaggacgucuucuucacgccgcccgagaagugcgacacccuccugugcgacaucggcgaguccagcccgaaccccacgaucgaggaggggcgcacccugcgggugcucaagaugguggagcccuggcugcgcggcaaccaguucugcaucaagauccugaaccccuacaugccguccgucguggagacccucgagcagaugcagcggaagcacggcgggaugcuggugcgcaacccccugagccggaacuccacccacgagauguacugggucagcugcggcacggggaacaucguguccgccgugaacaugaccagccgcaugcuccugaaccgcuucaccauggcccaccggaagcccaccuacgagcgcgacgucgaccugggcgccggcacgcggcacguggccguggagcccgaggucgcgaaccucgacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggugaacggcgucgugcggcugcugaccaagcccugggacgucauccccauggugacgcagaucgccaugaccgacaccaccccguucgggcagcagcgcguguucaaggagaaggucgacacgcggacgccccgggccaagcggggcaccgcgcagaucauggaggugaccgccaaguggcucuggggcuuccugucccgcaacaagaagccccggaucugcacgcgcgaggaguucacccggaaggugcgcagcaacgccgccaucggggccgucuucguggacgagaaccaguggaacagcgcgaaggaggccguggaggacgagcgguucugggaccuggucuaccgcgagcgggagcuccacaagcagggcaagugcgcgaccugcguguacaacaugauggggaagcgcgagaagaagcugggcgaguucgggaaggccaagggcucccgggcgaucugguacauguggcugggcgcccgcuuccucgaguucgaggcccugggguucaugaacgaggaccacugguucagccgggagaacuccuucagcggcguggagggggagggccugcacaagcucggguacauccugcgcgacaucuccaagaucccgggcggcaacauguacgccgacgacaccgccgggugggacacgcgcaucaccgaggacgaccugcagaacgaggcgaagaucaccgacaucauggagcccgagcacgcccuccuggccaccagcaucuucaagcugacguaccagaacaaggucgugcgggugcagcgccccgccaagaacggcaccgucauggacgugaucucccggcgcgaccagcgggggagcggccaggugggcaccuacgggcucaacaccuucacgaacauggagguccagcugauccgccagauggaguccgagggcaucuuccugcccagcgagcucgagaccccgaaccuggccgagcgggugcuggacuggcucgagaagcacgggaccgagcgccugaagcggauggcgaucuccggcgacgacugcguggucaagcccguggacgaccgcuucgccaccgcccugaucgcccucaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcuggucgggcgcgcccgggugagccagggcgcgggguggucccuccgcgagacggccugccugggcaagagcuacgcccagauguggcagcugauguacuuccaccggcgcgaccuccggcuggccgccaacgcgaucugcuccgccgugcccgucgacugggugcccaccagccgcaccaccuggagcauccacgcccaccaccaguggaugaccacggaggacaugcuguccguguggaaccgcgucuggaucgaggagaacccguggauggaggacaagacccacgugagcuccugggaggaggugcccuaccucgggaagcgggaggaccaguggugcggcagccugaucggccugaccgcccgcgcgaccugggccacgaacauccaggucgccaucaaccaggugcggcgccucaucgggaacgagaacuaccuggacuacaugaccuccaugaagcgguucaagaacgagagcgaccccgagggcgcccugugguga

SEQ ID NO: 8217 - RNA, 9879 nt, Artificial Sequence
  derived and/or modified CDS sequence (opt1) from DENV-1__FJ547086__SS-prME
agcgugaccaugcugcucaugcugcugcccaccgcccucgccuuccaccugaccacccggggcggggagccccacaugaucgugagcaagcaggagcggggcaagagccuccucuucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucauggugggcgccggcgagaaggcgcucaagcuguccugguucaagaaggggagcuccaucggcaagauguucgaggccaccgcccgcggggcccgccggauggccauccugggcgacacggcgugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccgccagccucuccaugaccugcaucgccgucgggauggugacccuguaccugggcgugaugguccaggccgacagcgggugcgcgaucaacuggaagggccgcgagcucaagugcggguccggcaucuucgugaccaacgaggugcacacguggaccgagcaguacaaguuccaggccgacagcccgaagcggcugagcgccgccaucggcaaggccugggaggagggggucugcggcauccgcuccgcgacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggagcacaaguacuccuggaaguccuggggcaaggccaagaucaucggcgcggacauccagaacaccacguucaucaucgacgggcccgacaccccggagugccccgacgaccagcgggccuggaacaucugggagguggaggacuacggcuucgggaucuucaccaccaacaucuggcugaagcugcgcgacuccuacacgcagaugugcgaccaccggcucaugagcgccgccaucaaggacuccaaggccgugcacgcggacaugggcuacuggaucgagagcgagaagaacgagaccuggaagcuggcccgcgccuccuucaucgaggucaagaccugcaucuggcccaagagccacacccugugguccaacggcgugcucgagagcgagaugaucauccccaagaucuacgggggcccgaucucccagcacaacuaccggcccggguacuucacgcagaccgccggccccuggcaccuggggaagcuggagcucgacuucgaccugugcgagggcaccaccguggucguggacgagcacugcggcaaccgcgggccgagccugcggacgaccaccgugaccggcaagaucauccacgaguggugcugccgcuccugcacgcugccgccccugcgguuccgcggggaggacggcugcugguacgggauggagauccggcccgucaaggagaaggaggagaaccuggugcgcagcaugguguccgccggcagcggcgaggucgacagcuucucccucgggauccugugcgugagcaucaugaucgaggaggugaugcggucccgcuggagccggaagaugcugaugaccggcacccucgcggucuuccugcugcucaucauggggcagcugaccuggaacgaccugauccgccucugcaucauggugggcgccaacgccuccgaccgcauggggaugggcacgaccuaccuggcccugauggccaccuucaagaugcggccgauguucgcggugggccuccuguuccgccggcugaccagccgcgagguccuccugcugacgaucgggcucucccugguggccagcguggagcugcccaacucccucgaggagcugggcgacgggcuggccaugggcaucaugaugcucaagcugcugaccgaguuccagccccaccagcucuggaccacccugcugagccucacguucaucaagaccacccugucccuggacuacgccuggaagaccauggcgaugguccucagcaucgugucccuguucccccugugccucagcacgaccucccagaagaccaccuggcugccgguccugcucggcagcuucgggugcaagccccugacgauguuccugaucaccgagaacaagaucuggggccggaaguccuggccccucaacgaggggaucauggccaucggcaucgugagcauccugcuguccagccuccugaagaacgacgugccccuggccgggccgcucaucgccggcggcaugcugaucgccugcuacgucaucagcggguccagcgcggaccugucccucgagaaggccgccgaggugagcugggaggaggaggccgagcacuccggcaccagccacaacauccugguggagguccaggacgacgggaccaugaagaucaaggacgaggagcgcgacgacacccugacgauccuccugaaggccacccugcucgcgguguccggcguguaccccaugagcauccccgccacccuguucgucugguacuucuggcagaagaagaagcagcgguccggggugcugugggacacccccagcccgcccgagguggagcgcgccguccucgacgacggcaucuaccggauccugcagcgcggccugcuggggcggucccaggugggcgugggggucuuccaggacggcguguuccacacgauguggcacgugacccgcggggccguccucauguaccagggcaagcggcuggagcccagcugggccuccgugaagaaggaccugaucagcuacggcgggggcuggcgcuuccagggguccuggaacaccggcgaggaggugcaggucaucgcgguggagcccgggaagaacccgaagaacgugcagaccacgcccggcaccuucaagacccccgagggcgaggucggggccaucgcccucgacuucaagcccggcaccagcggguccccgaucgugaaccgggagggcaagaucgugggccuguacgggaacggcgucgugacgaccagcgggaccuacguguccgccaucgcccaggcgaaggccagccagcagggcccccugcccgagaucgaggacgaggucuucaagaagcgcaaccucaccaucauggaccugcacccggggagcggcaagacgcggcgcuaccugcccgccaucgugcgggaggccaucaagcgcaagcuccggacccugauccuggcgcccacccgcguggucgccuccgagauggccgaggcccucaagggcaugcccauccgcuaccagaccacggccgucaagagcgagcacaccgggcgggagaucguggaccugaugugccacgcgaccuucaccaugcgccugcucuccccgguccgggugcccaacuacaacaugaucaucauggacgaggcccacuucacggaccccgccagcaucgccgcccgcggcuacaucuccacccggguggggaugggcgaggcggccgccaucuucaugaccgccacgccgcccgggagcgucgaggccuucccccaguccaacgcggugauccaggacgaggagcgcgacauccccgagcggagcuggaacuccggcuacgacuggaucacggacuuccccggcaagaccgugugguucguccccagcaucaaguccgggaacgacaucgccaacugccugcgcaagaacggcaagcgggugauccagcugagccgcaagaccuucgacaccgaguaccagaagacgaagaacaacgacugggacuacguggucaccaccgacaucuccgagaugggggccaacuuccgggccgaccgcgugaucgacccccggcgcugccucaagcccgugauccugaaggacggccccgagcgggucauccuggcggggccgaugcccgugaccguggccagcgccgcccagcgccggggccgcaucggccggaaccagaacaaggagggggaccaguacgucuacaugggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccgccugcgcggggaggcccgcaagaccuucguggagcugaugcggcgcggcgaccuccccgucuggcugagcuacaagguggcguccgagggcuuccaguacagcgaccggcgcuggugcuucgacggggagcggaacaaccaggugcuggaggagaacauggacgucgagaucuggaccaaggagggcgagcgcaagaagcuccggccccgcuggcuggacgcccggacguacuccgacccgcuggcccuccgcgaguucaaggaguucgccgccgggcggcgcagcgugagcggcgaccugauccuggagaucggcaagcucccccagcaccugacccugcgggcgcagaacgcccucgacaaccuggugaugcugcacaacuccgagcagggcgggaaggccuaccgccacgccauggaggagcuccccgacaccaucgagacccugaugcugcucgcgcugaucgccguccugaccgggggcgugacccucuucuuccugagcgggaagggccugggcaagaccuccaucgggcuccugugcgugauggccagcuccgcccugcucuggauggccagcgucgagccccacuggaucgcggccuccaucauccuggaguucuuccugauggugcuccugaucccggagcccgaccggcagcgcacgccccaggacaaccagcuggccuacguggucaucggccuccuguucaugauccugaccguggccgccaacgagauggggcuccuggagacgaccaagaaggaccugggcaucgggcacguggcggccgagaaccaccaccacgccaccaugcucgacgucgaccugcggccggccagcgccuggacccuguacgcgguggccacgaccgugaucacccccaugaugcgccacaccaucgagaacacgaccgccaacaucucccucaccgccaucgccaaccaggcggccauccugaugggccuggacaagggcuggcccaucagcaagauggacaucggggucccccuccuggcccugggcugcuacucccaggugaacccgcucacccugacggccgcggugcugaugcucgucgcccacuacgccaucaucgggcccggccugcaggccaaggccacccgggaggcgcagaagcgcaccgccgccgggaucaugaagaaccccaccguggacggcaucguggccaucgaccuggaccccgucguguacgacgccaaguucgagaagcagcucggccagaucaugcugcugauccucugcacgagccagauccugcugaugcgcaccaccugggcgcucugcgaguccaucacccuggccacggggccgcugaccacccucugggagggcagccccgggaaguucuggaacaccacgaucgccguguccauggccaacaucuuccggggcagcuaccuggccggcgcggggcuggccuucucccucaugaagucccugggcgggggccgccgggggaccggcgcccagggcgagacccugggggagaaguggaagcgccagcucaaccagcuguccaagagcgaguucaacaccuacaagcggagcggcaucauggaggucgaccgcuccgaggccaaggaggggcugaagcggggcgagacgaccaagcacgcggugagccgcgggaccgccaagcuccggugguucguggagcgcaaccuggucaagcccgagggcaaggugaucgaccugggcugcgggcggggcgggugguccuacuacugcgccggccugaagaaggugaccgaggucaagggguacacgaagggcggccccgggcacgaggagccgauccccauggccaccuacggcuggaaccucgugaagcugcacagcgggaaggacguguucuucacgccgcccgagaagugcgacacccugcucugcgacaucggcgaguccagcccgaaccccaccaucgaggaggggcgcacgcugcggguccugaagaugguggagcccuggcuccgcggcaaccaguucugcaucaagauccugaaccccuacaugccguccguggucgagacccuggagcagaugcagcggaagcacggcgggaugcucgugcgcaacccccugagccggaacuccacccacgagauguacugggugagcugcggcaccgggaacaucgucuccgccgugaacaugacgagccgcaugcugcucaaccgguucaccauggcgcaccgcaagcccaccuacgagcgcgacguggaccugggcgccggcacccggcacgucgccguggagcccgagguggccaaccuggacaucaucgggcagcgcaucgagaacaucaagaacgagcacaaguccacguggcacuacgacgaggacaacccguacaagaccugggccuaccacggcagcuacgaggucaagcccuccgggagcgcguccagcauggugaacggcgugguccggcuccugaccaagcccugggacgugauccccauggucacccagaucgccaugacggacaccaccccguucgggcagcagcgcguguucaaggagaagguggacacccggacgccccgcgccaagcggggcaccgcccagaucauggaggucaccgccaaguggcuguggggcuuccucucccgcaacaagaagccccggaucugcacccgcgaggaguucacgcggaaggugcgcagcaacgcggccaucggggccguguucgucgacgagaaccaguggaacagcgccaaggaggcgguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcguggagggggagggccugcacaagcucggguacauccugcgcgacaucuccaagaucccgggcggcaacauguacgccgacgacaccgccgggugggacacccggaucacggaggacgaccugcagaacgaggccaagaucaccgacaucauggagcccgagcacgcccuccuggcgaccagcaucuucaagcugaccuaccagaacaaggugguccgcgugcagcgccccgccaagaacggcacggugauggacgucaucucccggcgcgaccagcgggggagcggccaggugggcaccuacgggcucaacaccuucaccaacauggaggugcagcugauccgccagauggaguccgagggcaucuuccugcccugcgagcucgagacgccgaaccuggccgagcggguccuggacuggcucgagaagcacggggccgagcgccugaagcggauggccaucagcggcgacgacugcguggugaagcccaucgacgaccgcuucgcgaccgcccugaucgcccucaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcugguggggcgcgcccgggugucccagggcgccggguggagccuccgcgagaccgcgugccugggcaaguccuacgcccagauguggcagcugauguacuuccaccggcgcgaccuccggcuggccgccaacgcgaucugcagcgccguccccguggacugggugcccaccucccgcacgaccuggagcauccacgcccaccaccaguggaugaccaccgaggacaugcugagcgucuggaaccggguguggaucgaggagaacccguggauggaggacaagacccacguguccagcugggaggagguccccuaccucgggaagcgcgaggaccaguggugcggcucccugaucggccugacggcccgcgccaccugggcgaccaacauccagguggccaucaaccaggugcggcgccucaucgggaacgagaacuaccuggacuacaugaccagcaugaagcgguucaagaacgaguccaaccccgagggcgcccugugguga

SEQ ID NO: 8218 - RNA, 9879 nt, Artificial Sequence
  derived and/or modified CDS sequence (opt1) from DENV-1__FJ410183__SS-prME
agcgugaccaugcugcucaugcugcugcccaccgcccucgccuuccaccugaccacccggggcggggagccccacaugaucgugagcaagcaggagcggggcaagagccuccucuucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccgucgcccuggcgccccacgugggccuggggcucgagacgcgcaccgagaccuggaugagcuccgagggcgccuggaagcagauccagaagguggagaccugggcccugcggcaccccggguucacggucaccgccuucuuccuggcgcacgccaucggcaccagcaucacccagaaggggaucaucuucauccuccugaugcuggugacgcccuccauggccaugcgcugcgugggcaucggcaaccgggacuucgucgaggggcucagcggcgccaccuggguggacgugguccuggagcacggguccugcgugaccaccauggccaaggacaagcccacgcuggacaucgagcuccugaagaccgaggugaccaaccccgcgguccugcgcaagcucugcaucgaggccaagaucagcaacaccacgaccgacucccggugcccgacccagggcgaggccacccugguggaggagcaggacagcaacuucgugugccgccggacguucgucgaccgcggcugggggaacggcugcgggcuguucggcaaggggucccuccugaccugcgccaaguucaagugcgugaccaagcuggagggcaagaucgugcaguacgagaaccucaaguacagcgucaucgugaccgugcacacgggcgaccagcaccaggucgggaacgagaccaccgagcacggcaccaucgccaccaucacgccccaggcgcccaccuccgagauccagcugaccgacuacggggcccugacccucgacugcagcccccggacgggccuggacuucaacgagauggugcugcucaccaugaaggagaaguccuggcugguccacaagcagugguuccuggaccucccgcugcccuggaccagcggggccagcaccucccaggagacguggaaccgccaggaccugcucgugaccuucaagaccgcccacgccaagaagcaggagguggucgugcugggcagccaggagggcgcgaugcacaccgcccugacgggggccaccgagauccagaccuccggcaccacgaccaucuucgccgggcaccucaagugccggcugaagauggacaagcugacccucaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccugaucacggccaacccgaucgugaccgacaaggagaagcccgucaacaucgagaccgagccgcccuucggggaguccuacaucguggugggcgccggcgagaaggcgcucaagcugagcugguucaagaagggguccagcaucggcaagauguucgaggccaccgcccgcggggcccgccggauggccauccugggcgacacggcgugggacuucggguccaucggcggcgucuucaccagcguggggaagcucgugcaccaggucuucggcgccgccuacggggugcuguucuccggcgugagcuggaccaugaagaucgggaucggcauccugcucaccuggcugggccugaacucccgcagcacgucccucagcaugaccugcaucgccgucgggauggugacccuguaccugggcgugaugguccaggccgacuccgggugcgugaucaacuggaagggccgcgagcucaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucaccguggucgugggggacgcgaacggcauccucgcccaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgcguggaacaucugggagguggaggacuacggcuucgggaucuucaccaccaacaucuggcugaagcugcgggacagcuacacgcagaugugcgaccaccgccucauguccgccgccaucaaggacagcaaggccguccacgccgacaugggcuacuggaucgaguccgagaagaacgagaccuggaagcuggcgcgggccagcuucaucgaggugaagaccugcaucuggcccaagucccacacccuguggagcaacggcgugcucgaguccgagaugaucauccccaagauguacgggggcccgacgagccagcacaacuaccgccccggguacuucacccagaccgccggccccuggcaccuggggaagcuggagcucgacuucgaccugugcgagggcaccacggucgugguggacgagcacugcggcaaccgggggccgucccugcgcaccaccaccgucacgggcaagaucauccacgaguggugcugccggagcugcacccugccgccccugcgcuuccgcggggaggacggcugcugguacgggauggagauccgccccgugaaggagaaggaggagaaccuggugcgguccauggucagcgccggcagcggcgagauggacuccuucagccucgggauccugugcguguccaucaugaucgaggaggugaugcgcagccgguggucccgcaagaugcugaugaccggcacccucgccgucuuccugcugcucaucauggggcagcugacguggaacgaccugauccgccucugcaucauggugggcgcgaacgccagcgaccggauggggaugggcaccaccuaccuggcccugauggccaccuucaagaugcgcccgauguucgccgugggccuccuguuccggcgccugacgucccgggagguccuccugcugaccaucgggcucagccugguggcguccguggagcugcccaacagccucgaggagcugggcgacgggcuggccaugggcaucaugaugcucaagcugcugaccgaguuccagccccaccagcucuggaccacgcugcugucccucaccuucaucaagaccacccugagccuggacuacgccuggcgcacgauggccaugguccucuccaucgugagccuguucccccugugccucuccaccaccagccagaagaccacguggcugccgguccugcucggcuccuucgggugcaagccccugaccauguuccugaucaccgagaacaagaucuggggccgcaagagcuggccccucaacgaggggaucauggcgaucggcaucguguccauccugcugagcagccuccugaagaacgacgugccccuggccgggccgcucaucgccggcggcaugcugaucgccugcuacgucaucuccgggagcuccgccgaccugagccucgagaaggcggccgagguguccugggaggaggaggccgagcacagcggcaccucccacaacauccugguggagguccaggacgacgggaccaugaagaucaaggacgaggagcgcgacgacacgcugaccauccuccugaaggccacccugcucgccgugagcggcguguaccccauguccauccccgcgacccuguucgucugguacuucuggcagaagaagaagcagcggagcggggugcugugggacacgcccuccccgcccgagguggagcgcgccguccucgacgacggcaucuaccggauccugcagcgcggccugcuggggcggagccaggugggcgugggggucuuccaggacggcguguuccacaccauguggcacgugacccgcggggccguccucauguaccagggcaagcggcuggagcccuccugggccagcgugaagaaggaccugaucuccuacggcgggggcuggcgcuuccaggggagcuggaacaccggcgaggaggugcaggucaucgccguggagcccgggaagaacccgaagaacgugcagacgacccccggcaccuucaagacccccgagggcgaggucggggcgaucgcccucgacuucaagcccggcacguccgggagcccgaucgugaaccgggagggcaagaucgugggccuguacgggaacggcgucgugaccaccuccgggaccuacgugagcgccaucgcccaggccaagacgagccaggagggcccccugcccgagaucgaggacgaggucuucaagaagcgcaaccucaccaucauggaccugcacccgggguccggcaagacccggcgcuaccugcccgcgaucgugcgggaggccaucaagcgcaagcuccgcacccugauccuggcccccacgcggguggucgccagcgagauggcggaggcccucaagggcaugcccauccgcuaccagaccaccgccgugaaguccgagcacaccgggcgggagaucguggaccugaugugccacgccacguucaccaugcgccugcucagcccgguccgggugcccaacuacaacaugaucaucauggacgaggcccacuucaccgaccccgcguccaucgccgcccgcggcuacaucagcacccggguggggaugggcgaggccgccgcgaucuucaugacggccacgccgcccggguccgucgaggccuucccccagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcugucccgcaagacguucgacaccgaguaccagaagaccaagaacaacgacugggacuacguggucaccacggacaucagcgagaugggggcgaacuuccgggccgaccgcgugaucgacccccggcgcugccucaagcccgugauccugaaggacggccccgagcgggucauccuggccgggccgaugcccgugaccguggccuccgcggcccagcgccggggccgcaucggccgcaaccagaacaaggagggggaccaguacgucuacaugggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugcgcggggaggcccgcaagacguucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccgcuggcgcuccgcgaguucaaggaguucgccgccgggcggcgcagcguguccggcgaccugauccuggagaucggcaagcucccccagcaccugacccugcgggcccagaacgcccucgacaaccuggugaugcugcacaacagcgagcagggcgggaaggcguaccgccacgccauggaggagcuccccgacaccaucgagacgcugaugcugcucgcccugaucgccguccugaccgggggcgugacccucuucuuccuguccgggaagggccugggcaagaccagcaucgggcuccugugcgugauggcguccagcgcccugcucuggauggccaacgucgagccccacuggaucgccgccuccaucauccuggaguucuuccugauggugcuccugaucccggagcccgaccggcagcgcacgccccaggacaaccagcuggcguacguggucaucggccuccuguucaucauccugaccguggccgccaacgagauggggcuccuggagaccaccaagaaggaccugggcaucgggcacguggccgccgagagccagcaccacgcgacgaugcucgacgucgaccugcggccggccuccgccuggacccuguacgccguggccaccaccgugaucacgcccaugaugcgccacaccaucgagaacaccaccgcgaacaucagccucacggccaucgccaaccaggccgccauccugaugggccuggacaagggcuggcccaucuccaagauggacaucggggucccccuccuggcgcugggcugcuacagccaggugaacccgcucacccugaccgccgccgugcugaugcucgucgcccacuacgcgaucaucgggcccggccugcaggccaaggccacccgcgaggcccagaagcggacggccgcggggaucaugaagaaccccaccguggacggcaucguggccaucgaccuggaccccgucguguacgacgccaaguucgagaagcagcucggccagaucaugcugcugauccucugcaccucccagauccugcugaugcgcaccacgugggcccucugcgagagcaucacccuggccaccgggccgcugaccacgcucugggagggcucccccgggaaguucuggaacaccaccaucgcggugagcauggccaacaucuuccggggcuccuaccuggccggcgccgggcuggccuucagccucaugaagucccugggcgggggccgccgggggaccggcgcgcagggcgagacgcugggggagaaguggaagcgccagcucaaccagcugagcaagagcgaguucaacaccuacaagcgguccggcaucauggaggucgaccgcagcgaggccaaggaggggcugaagcggggcgagaccaccaagcacgccgugucccgcgggacggccaagcuccggugguucguggagcgcaaccuggucaagcccgagggcaaggugaucgaccugggcugcgggcggggcggguggagcuacuacugcgcgggccugaagaaggugaccgaggucaagggguacaccaagggcggccccgggcacgaggagccgauccccauggccaccuacggcuggaaccucgugaagcuguacuccgggaaggacguguucuucacgccgcccgagaagugcgacacgcugcucugcgacaucggcgagagcuccccgaaccccaccaucgaggaggggcgcacccugcggguccugaagaugguggagcccuggcuccgcggcaaccaguucugcaucaagauccugaaccccuacaugccgagcguggucgagacccuggagcagaugcagcggaagcacggcgggaugcucgugcgcaacccccugucccggaacagcacgcacgagauguacuggguguccugcggcaccgggaacaucgucagcgccgugaacaugaccucccgcaugcugcucaaccgcuucaccauggcccaccggaagcccacguacgagcgcgacguggaccugggcgccggcacccggcacgucgcgguggagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgccagcuccauggugaacggcgugguccggcuccugacgaagcccugggacgugauccccauggucacccagaucgccaugaccgacaccacgccguucgggcagcagcgcguguucaaggagaagguggacacccggacgccccgggcgaagcggggcaccgcccagaucauggaggucacggccaaguggcuguggggcuuccucagccgcaacaagaagccccggaucugcacccgcgaggaguucacccggaaggugcgcagcaacgccgccaucggggcgguguucgucgacgagaaccaguggaacuccgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggcgaagggcagccgggccaucugguacauguggcugggcgcccgcuuccuggaguucgaggcccucggguucaugaacgaggaccacugguucucccgggagaacagcuucuccggcguggagggggagggccugcacaagcugggguacauccuccgcgacaucagcaagaucccgggcggcaacauguacgccgacgacacggcggggugggacacccgcaucaccgaggacgaccugcagaacgaggccaagaucaccgacaucauggagcccgagcacgcccugcucgccacguccaucuucaagcugaccuaccagaacaaggugguccgggugcagcgccccgccaagaacggcaccgugauggacgucaucagccggcgcgaccagcggggguccggccaggugggcaccuacgggcugaacacguucaccaacauggaggugcagcucauccgccagauggagagcgagggcaucuuccugcccuccgagcuggagaccccgaaccucgcggagcggguccuggacuggcuggagaagcacgggaccgagcgccucaagcggauggccaucagcggcgacgacugcguggugaagcccgucgacgaccgcuucgccacggcccugaucgcccugaacgacauggggaaggugcggaaggacaucccccagugggagcccuccaagggcuggaacgacuggcagcaggucccguucugcagccaccacuuccaccagcucaucaugaaggacggccgcgagaucgucgugcccugccggaaccaggacgagcugguggggcgcgcgcgggucucccagggcgccggguggagccugcgcgagaccgccugccucggcaaguccuacgcccagauguggcagcugauguacuuccaccggcgcgaccugcggcucgccgcgaacgccaucugcagcgccgugcccguggacuggguccccaccagccgcaccaccugguccauccacgcccaccaccaguggaugacgaccgaggacaugcugagcguguggaaccgcguguggaucgaggagaacccguggauggaggacaagacccacgucuccagcugggaggaggugcccuaccuggggaagcgggaggaccaguggugcggcucccucaucggccugaccgcgcgcgccacgugggccaccaacauccagguggccaucaaccagguccggcgccugaucgggaacgagaacuaccucgacuacaugaccagcaugaagcgguucaagaacgaguccgaccccgagggcgcccugugguga

SEQ ID NO: 8219 - RNA, 9879 nt, Artificial Sequence
  derived and/or modified CDS sequence (opt1) from DENV-1__FJ410184__SS-prME
agcgugaccaugcugcucaugcugcugcccaccgcccucgccuuccaccugaccacccggggcggggagccccacaugaucgugagcaagcaggagcggggcaagagccuccuguucaagaccagcgcggggaucaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgggacaagcgguccgucgcccuggcgccccacgugggccuggggcucgagacgcgcaccgagaccuggaugagcuccgagggcgccuggaagcagauccagaagguggagaccugggcccugcggcaccccggguucacggucaucgcccuguuccucgcgcacgccaucggcaccagcaucacccagaaggggaucaucuucauccugcugaugcucgugacccccuccauggccaugcgcugcgugggcaucggcaaccgggacuucgucgaggggcugagcggcgccacguggguggacgugguccuggagcacggguccugcgugaccaccauggccaaggacaagcccacccucgacaucgagcugcugaagacggaggugaccaaccccgcgguccuccgcaagcugugcaucgaggccaagaucagcaacaccaccacggacucccggugccccacccagggcgaggccacccugguggaggagcaggacgccaacuucgugugccgccggaccuucgucgaccgcggcugggggaacggcugcggccuguucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagaaguccuggcugguccacaagcagugguuccucgaccugccccugcccuggaccuccggggccagcaccagccaggagaccuggaaccgccaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggaggucgcggagacccagcacggcacggugcuggugcaggucaaguacgagggcaccgacgcccccugcaagauccccuucuccgcccaggacgagaagggggugacccagaacggccgccucaucaccgccaacccgaucgugacggacaaggagaagcccgucaacaucgagaccgagccgcccuucggggagagcuacaucguggugggcgcgggcgagaaggcccugaagcuguccugguucaagaaggggagcuccaucggcaagauguucgaggccaccgcccgcggggcgcgccggauggcgauccucggcgacaccgccugggacuucgggagcaucggcggcgucuucacguccguggggaagcuggugcaccaggucuucggcaccgccuacggggugcuguucagcggcguguccuggaccaugaagaucgggaucggcauccuccugaccuggcugggccucaacagccgcuccacgagccuguccaugaccugcaucgccgucgggauggugacccuguaccucggcgugaugguccaggccgacagcgggugcgugaucaacuggaagggccgcgagcugaagugcggguccggcaucuucgugaccaacgagguccacacguggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccguggucgugggggacgcgaacggcauccuggcccaggggaagaagaugauccgcccccagcccauggagcaccgguacuccuggaaguccuggggcaaggccaagaucaucggcgccgacauccagaacaccacguucaucaucgacgggcccgacaccccggagugccccgacgaccagcgcgcguggaacaucugggagguggaggacuacggcuucgggaucuucaccaccaacaucuggcugaagcuccgggacuccuacacgcagaugugcgaccaccgccugaugagcgccgccaucaaggacuccaaggccguccacgccgacaugggcuacuggaucgagagcgagaagaacgagaccuggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagcgggaggagaaccucgucaagagcauggucuccgccggccugggcgagguggacagcuucagccuggggauccucugcguguccaucaugaucgaggaggucaugcgcagccgguggucccgcaagaugcugaugaccggcacccuggccguguuccuccugcugaucauggggcagcucaccuggaacgaccugauccgccugugcaucauggugggcgcgaacgccagcgaccggauggggaugggcacgaccuaccucgcccugauggccaccuucaagaugcgcccgauguucgccgucggccuccucuuccggcgccugaccucccgggaggugcugcuccugacgaucgggcugagccucguggcguccgucgagcugcccaacagccuggaggagcucggcgacgggcuggccaugggcaucaugaugcugaagcuccugaccgaguuccagccccaccagcuguggaccacccuccugucccugacguucaucaagaccacccucagccuggacuacgccuggaagaccauggccauggugcuguccaucgucagccucuucccccugugccuguccacgaccagccagaagaccaccuggcucccggugcugcugggcucccucgggugcaagccccugacgauguuccugaucaccgagaacaagaucuggggccgcaagagcuggccccucaacgaggggaucauggcgaucggcaucguguccauccugcugagcucccuccugaagaacgacgucccccuggccgggccgcucaucgccggcggcaugcugaucgccugcuacgugaucagcgggagcuccgccgaccugagccucgagaaggcggccgagguguccugggaggaggaggccgagcacagcggcaccucccacaacauccuggucgaggugcaggacgacgggaccaugaagaucaaggacgaggagcgggacgacacccugacgauccuccugaaggccacccugcucgccgugagcggcgucuaccccauguccauccccgcgacccuguucgugugguacuucuggcagaagaagaagcagcgcagcggggugcugugggacacccccuccccgcccgaggucgagcgggccgugcuggacgacggcaucuaccgcauccuccagcggggccugcuggggcgcagccaggugggcgucgggguguuccaggacggcguguuccacacgauguggcacgucacccgcggggccgugcucauguaccagggcaagcgccuggagcccuccugggccagcgugaagaaggaccugaucuccuacggcgggggcuggcgguuccagggggccuggaacaccggcgaggagguccaggugaucgcgguggagcccgggaagaacccgaagaacguccagaccacgcccggcaccuucaagacccccgagggcgaggugggggccaucgcccucgacuucaagcccggcaccagcggguccccgaucgugaaccgcgagggcaagaucgucggccuguacgggaacggcguggugacgaccagcgggaccuacgucuccgccaucgcccaggcgaagaccagccaggagggcucccugcccgagaucgaggacgagguguucaagaagcggaaccucacgaucauggaccugcaccccgggagcggcaagacccgccgguaccugccggccaucgugcgcgaggccaucaagcggaagcuccgcacccugauccuggcccccacccgcgucguggcgagcgagauggccgaggcccucaagggcaugcccauccgguaccagacgaccgccgugaaguccgagcacaccgggcgcgagaucgucgaccugaugugccacgccaccuucacgaugcggcugcucagccccgugcgcgugccgaacuacaacaugaucaucauggacgaggcgcacuucaccgaccccgccuccaucgccgcccggggcuacaucagcacccgcgucgggaugggcgaggccgcggccaucuucaugaccgccacgccgcccggguccguggaggccuucccgcagagcaacgccgugauccaggacgaggagcgggacauccccgagcgcuccuggaacagcggcuacgacuggaucaccgacuuccccggcaagaccgucugguucgugcccuccaucaagagcgggaacgacaucgcgaacugccugcggaagaacggcaagcgcgugauccagcugucccggaagaccuucgacacggaguaccagaagaccaagaacaacgacugggacuacgucgugaccaccgacaucagcgagaugggggccaacuuccgcgccgaccgggugaucgacccgcgccggugccucaagcccgucauccugaaggacggccccgagcgcgugauccuggccgggcccaugccggugacggucgcguccgccgcccagcggcgcggccggaucggccgcaaccagaacaaggagggggaccaguacguguacaugggccagccccucaacaacgacgaggaccacgcccacuggaccgaggccaagaugcugcuggacaacaucaacacccccgaggggaucauccccgcccucuucgagccggagcgcgagaaguccgccgccaucgacggcgaguaccggcugcgcggggaggcccggaagaccuucgucgagcugaugcgccggggcgaccuccccguguggcuguccuacaagguggccagcgagggcuuccaguacuccgaccgccgguggugcuucgacggggagcgcaacaaccagguccuggaggagaacauggacguggagaucuggacgaaggagggcgagcggaagaagcuccgcccccgguggcuggacgcgcgcaccuacagcgacccccuggcccuccgggaguucaaggaguucgccgccgggcgccgguccgugagcggcgaccugauccuggagaucggcaagcucccgcagcaccugacccugcgcgcccagaacgcgcucgacaaccuggucaugcugcacaacagcgagcagggcgggaaggccuaccggcacgccauggaggagcuccccgacaccaucgagacccugaugcugcucgcccugaucgcggugcugaccggcggggugacccucuucuuccuguccgggaaggggcugggcaagaccagcaucgggcuccugugcgucauggccuccagcgcccugcucuggauggccuccguggagccccacuggaucgccgcgagcaucauccuggaguucuuccugauggugcuccugauccccgagccggaccgccagcggacgccccaggacaaccagcuggccuacgucgugaucggccuccuguucaugauccugacgguggccgccaacgagauggggcuccuggagaccaccaagaaggaccugggcaucggguacgucgccgcggagaaccaccaccacgccaccaugcucgacguggaccugcgccccgccuccgccuggacgcuguacgccguggcgaccaccgucaucaccccgaugaugcggcacacgaucgagaacaccaccgccaacaucagccucaccgccaucgccaaccaggccgcgauccugaugggccuggacaagggcuggcccaucuccaagauggacaucggggugccccuccuggcccugggcugcuacagccaggugaacccccucacgcugaccgccgccguccugaugcucguggcgcacuacgccaucaucgggccgggccugcaggccaaggccacccgcgaggcccagaagcgcaccgcggccgggaucaugaagaaccccacgguggacggcaucgucgccaucgaccuggaccccgugguguacgacgccaaguucgagaagcagcucggccagaucaugcugcugauccucugcaccucccagauccugcugaugcggaccaccugggcccucugcgagagcaucacgcuggcgaccgggccccugaccacccucugggagggcuccccggggaaguucuggaacacgaccaucgccgucagcauggccaacaucuuccgcggcuccuaccuggccggcgccgggcuggcguucagccucaugaagucccugggcgggggccggcgcgggaccggcgcccagggcgagacccugggggagaaguggaagcggcagcucaaccagcugagcaaguccgaguucaacacguacaagcgcagcggcaucauggagguggaccggagcgaggccaaggaggggcugaagcgcggcgagaccaccaagcacgccgugucccgggggaccgcgaagcugcgcugguucgucgagcggaaccucgugaagcccgagggcaaggugaucgaccugggcugcgggcgcggcggguggagcuacuacugcgccggccugaagaaggucacggaggugaagggguacaccaagggcggccccgggcacgaggagcccaucccgauggccaccuacggcuggaaccucgugaagcugcacuccgggaaggacgucuucuucacgccgcccgagaagugcgacacccugcucugcgacaucggcgagagcucccccaacccgacgaucgaggaggggcggacccugcgcgugcugaagaugguggagcccuggcuccggggcaaccaguucugcaucaagauccugaaccccuacaugcccagcgucguggagacccuggagcagaugcagcgcaagcacggcgggaugcucgugcggaacccgcugucccgcaacagcacccacgagauguacugggucuccugcggcacggggaacaucgugagcgccgugaacaugaccucccggaugcugcucaaccgcuucaccauggcccaccgcaagcccaccuacgagcgggacgucgaccugggcgcgggcacgcgccacguggccguggagcccgaggucgccaaccuggacaucaucgggcagcggaucgagaacaucaagaacgagcacaagagcaccuggcacuacgacgaggacaaccccuacaagaccugggccuaccacggcuccuacgaggugaagccgagcggguccgccagcuccauggugaacggcgucgugcgccuccugaccaagcccugggacgucauccccauggugacgcagaucgcgaugaccgacaccacccccuucgggcagcagcggguguucaaggagaaggucgacacgcgcaccccgcgggccaagcgcggcaccgcccagaucauggaggugaccgccaaguggcuguggggcuuccucagccggaacaagaagccccgcaucugcacgcgggaggaguucacccgcaaggugcgguccaacgccgcgaucggggccgucuucguggacgagaaccaguggaacagcgccaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcccucggguucaugaacgaggaccacugguucucccgcgagaacagcuucuccggcguggagggggagggccugcacaagcugggguacauccuccgggacaucagcaagauccccggcggcaacauguacgcggacgacaccgccgggugggacacgcgcaucaccgaggacgaccugcagaacgaggccaagaucaccgacaucauggagccggagcacgcccugcucgccaccuccaucuucaagcugacguaccagaacaaggucgugcgcgugcagcggcccgcgaagaacggcaccgucauggacgugaucagccgccgggaccagcgcggguccggccaggugggcaccuacgggcugaacaccuucacgaacauggagguccagcucauccggcagauggagagcgagggcaucuuccugcccuccgagcuggagacccccaaccucgccgagcgcgugcuggacuggcuggagaagcacgggaccgagcggcucaagcgcauggccaucagcggcgacgacugcguggucaagccgguggacgaccgguucgccaccgcccugaucgcgcugaacgacauggggaaggugcgcaaggacaucccccagugggagcccuccaagggcuggaacgacuggcagcagguccccuucugcagccaccacuuccaccagcucaucaugaaggacggccgggagaucguggugccgugccgcaaccaggacgagcuggucgggcgggcccgcgugucccagggcgccggguggagccugcgggagacggccugccucggcaaguccuacgcccagauguggcagcugauguacuuccaccgccgggaccugcgccucgcggccaacgccaucugcagcgccgugcccgucgacugggugcccaccucccggaccaccuggagcauccacgcgcaccaccaguggaugaccacggaggacaugcugagcguguggaaccgcgucuggaucgaggagaaccccuggauggaggacaagacccacguguccagcugggaggaggugccguaccuggggaagcgcgaggaccaguggugcggcucccucaucggccugaccgcccgggccaccugggccacgaacauccaggucgccaucaaccaggugcgccggcugaucgggaacgagaacuaccucgacuacaugaccagcaugaagcgcuucaagaacgaguccgaccccgagggcgcgcugugguga

SEQ ID NO: 8220 - RNA, 9879 nt, Artificial Sequence
  derived and/or modified CDS sequence (opt1) from DENV-1__FJ410185__SS-prME
agcgugaccaugcugcucaugcugcugcccaccgcccucgccuuccaccugaccacccggggcggggagccccacaugaucgucagcaagcaggagcggggcaagagccugcuguucaagaccagcguggggaucaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggaagcagauccagaaggucgagaccugggcccugcggcacccgggguucaccgugaucgcccuguuccucgcccacgcgaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaaggacaagcccacccucgacaucgagcugcugaagacggaggucaccaaccccgccgugcuccgcaagcugugcaucgaggcgaagaucagcaacaccaccacggacucccggugcccgacccagggcgaggccacccugguggaggagcaggacagcaacuucgucugccgccggaccuucguggaccgcggcugggggaacggcugcggccucuucggcaaggggucccugcugacgugcgccaaguucaagugcgugaccaagcucgagggcaagaucguccaguacgagaaccugaaguacagcgugaucgugaccguccacaccggcgaccagcaccagguggggaacgagacgaccgagcacggcaccaucgccaccaucacgccccaggcccccacguccgagauccagcugaccgacuacggggcgcucacccuggacugcagcccccggaccggccuggacuucaacgagaugguccuccugacgaugaaggagaaguccuggcuggugcacaagcagugguuccucgaccugccgcugcccuggaccagcggggccagcaccucccaggagaccuggaaccgccaggaccuccuggugacguucaagaccgcccacgccaagaagcaggaggucguggugcugggcagccaggagggcgccaugcacaccgcgcucaccggggccacggagauccagaccuccggcaccaccacgaucuucgccgggcaccugaagugccggcugaagauggacaagcucacccugaagggcaugagcuacgucaugugcaccggguccuucaagcuggagaaggagguggccgagacccagcacggcacggugcugguccaggugaaguacgagggcaccgacgcccccugcaagauccccuucagcgcgcaggacgagaagggggugacccagaacggccgccucaucaccgccaacccgaucgucacggacaaggagaagcccgugaacaucgagaccgagccgcccuucggggaguccuacaucgugaucggcgccggcgagaaggcccugaagcugagcugguucaagaagggguccagcaucggcaagauguucgaggcgaccgcccgcggggcccgccggauggccauccucggcgacaccgccugggacuucggguccaucggcggcgucuucacgagcguggggaagcuggugcaccaggucuucggcgcggccuacggggugcuguucuccggcgugagcuggaccaugaagaucgggaucggcauccuccugaccuggcugggccucaacucccgcagcaccucccugagcaugacgugcaucgccgucgggauggugacccuguaccucggcgugaugguccaggccgacuccgggugcgugaucaacuggaagggccgcgagcugaagugcgggagcggcaucuucgugaccaacgagguccacaccuggacggagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucaccguggucgugggggacgccaacggcauccuggcgcaggggaagaagaugauccgcccccagcccauggagcaccgguacagcuggaaguccuggggcaaggccaagaucaucggcgccgacauccagaacaccaccuucaucaucgacgggcccgacacgccggagugccccgacgaccagcgcgccuggaacaucugggagguggaggacuacggcuucgggaucuucaccaccaacaucuggcugaagcuccgggacagcuacacccagaugugcgaccaccgccugauguccgcggccaucaaggacagcaaggccguccacgccgacaugggcuacuggaucgaguccgagaagaacgagacguggaagcuggcccgggcgagcuucaucgaggugaagaccugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgucgugguggacgagcacugcggcaaccgggggccgucccuccgcaccacgaccgucaccggcaagaucauccacgaguggugcugccggagcugcacccugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugacgggcacccuggccguguuccugcuccugaucauggggcagcugaccuggaacgaccucauccgccugugcaucauggugggcgccaacgcgagcgaccggauggggaugggcaccacguaccuggcccucauggccaccuucaagaugcgcccgauguucgccgucggccugcuguuccggcgccucaccucccgggaggugcugcugcucaccaucgggcugagccugguggccuccgucgagcuccccaacagccuggaggagcugggcgacgggcucgcgaugggcaucaugaugcugaagcugcucacggaguuccagccccaccagcuguggaccacccugcucucccugaccuucaucaagacgacccugagccucgacuacgccuggcgcaccauggccauggugcuguccaucgucagccuguucccccucugccuguccaccacgagccagaagaccaccuggcugccggugcuccugggcuccuucgggugcaagccccugaccauguuccucaucacggagaacaagaucuggggccgcaagagcuggccccugaacgaggggaucauggccaucggcaucguguccauccugcucagcagccugcugaagaacgacgucccccucgcggggccgcugaucgccggcggcaugcugaucgccugcuacgugaucuccgggagcuccgccgaccucagccuggagaaggccgcggagguguccugggaggaggaggccgagcacagcggcaccucccacaacauccuggucgaggugcaggacgacgggaccaugaagaucaaggacgaggagcgcgacgacacccucaccauccugcugaaggccacgcuccuggccgugagcggcgucuaccccauguccauccccgccacccuguucgugugguacuucuggcagaagaagaagcagcggagcggggugcucugggacacccccuccccgcccgaggucgagcgcgcggugcuggacgacggcaucuaccggauccugcagcgcggccugcucgggcggagccaggugggcgucgggguguuccaggacggcguguuccacaccauguggcacgucacgcgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacccccggcacguucaagacccccgagggcgaggugggggccaucgcgcuggacuucaagcccggcaccuccgggagcccgaucgugaaccgggaggagaagaucgucggccuguacggcaacgggguggugaccacguccggcaccuacgucagcgccaucgcccaggccaagaccagccaggaggggccccuccccgagaucgaggacgagguguucaagaagcgcaaccugaccaucauggaccugcacccgggcuccgggaagacgcggcgcuaccuccccgccaucgugcgggaggcgaucaagcgcaagcugcgcacccugauccucgcccccacccgggucguggccagcgagauggccgaggcgcugaagggcaugcccauccgcuaccagaccacggccgugaaguccgagcacaccggccgggagaucgucgaccugaugugccacgccaccuucaccaugcgccuccugagcccggugcgggugcccaacuacaacaugaucaucauggacgaggcccacuucacggaccccgccuccaucgcggcccgcggguacaucagcacccgggucggcaugggggaggccgccgccaucuucaugaccgcgacgccgcccggcuccguggaggccuucccccagagcaacgccgugauccaggacgaggagcgcgacauccccgagcgguccuggaacagcggguacgacuggaucacggacuuccccggcaagaccgucugguucgugcccuccaucaagagcggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggcggaccgcgugaucgacccccggcgcugccugaagcccgucauccugaaggacgggcccgagcgggugauccucgccggcccgaugcccgugaccgucgccuccgccgcgcagcgccgggggcgcaucggccgcaaccagaacaaggagggcgaccaguacguguacauggggcagccccugaacaacgacgaggaccacgcccacuggacggaggccaagaugcugcucgacaacaucaacacccccgagggcaucaucccggcccuguucgagcccgagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacuccgaccggcgcuggugcuucgacggcgagcggaacaaccagguccucgaggagaacauggacguggagaucuggaccaaggagggggagcgcaagaagcugcggccccgcuggcuggacgcccggacguacagcgacccgcucgcccugcgcgaguucaaggaguucgcggccggccggcgcagcguguccggggaccugauccucgagaucggcaagcugccccagcaccugacccuccgggcccagaacgcccuggacaaccuggucaugcuccacaacagcgagcagggcgggaaggccuaccgccacgcgauggaggagcugcccgacaccaucgagacccugaugcuccuggcccugaucgccgugcucaccggcggggugacgcuguucuuccuguccggcaaggggcucggcaagaccagcaucggccugcugugcgucauggccuccagcgcgcuccuguggauggccaacguggagccccacuggaucgccgccuccaucauccuggaguucuuccucauggugcugcugaucccggagcccgaccggcagcgcacgccccaggacaaccagcucgccuacgucgugaucgggcugcuguucaugauccucaccguggcggccaacgagaugggccugcuggagacgaccaagaaggaccucgggaucggccacgucgccgccgagaaccagcaccacgccaccaugcuggacguggaccugcggccggcgagcgccuggacccucuacgccguggccacgaccgucaucacccccaugaugcgccacaccaucgagaacacgaccgccaacaucucccugaccgcgaucgccaaccaggccgccauccugauggggcucgacaagggcuggcccaucagcaagauggacaucggcgugccccugcuggcccucgggugcuacucccaggugaacccgcugacccugacggcggccguccucaugcugguggcccacuacgccaucaucggccccgggcugcaggcgaaggccacccgcgaggcccagaagcggaccgccgccggcaucaugaagaaccccaccguggacgggaucgucgcgaucgaccucgaccccgugguguacgacgccaaguucgagaagcagcugggccagaucaugcugcucauccugugcacgagccagauccugcucaugcgcaccaccugggcccugugcgaguccaucacccuggccacgggcccgcucaccacccugugggaggggagccccggcaaguucuggaacaccacgaucgccgucuccauggcgaacaucuuccgggggagcuaccuggccggcgccggccucgccuucucccugaugaagucccucgggggcgggcgccgggggaccggggcccagggcgagacccucggcgagaaguggaagcgccagcugaaccagcuguccaagagcgaguucaacaccuacaagcggagcgggaucauggagguggaccgcuccgaggcgaaggagggccucaagcgcggggagacgaccaagcacgccgugagccgcggcaccgccaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcgggcccggccacgaggagccgauccccauggcgaccuacggguggaaccuggugaagcuguacagcggcaaggacgucuucuucacgccgcccgagaagugcgacacccuccugugcgacaucggggaguccagcccgaaccccaccaucgaggagggccgcacgcugcgggugcucaagaugguggagcccuggcugcgcgggaaccaguucugcaucaagauccugaaccccuacaugccguccgucguggagacccucgagcagaugcagcggaagcacggcggcaugcuggugcgcaacccccugagccggaacuccacccacgagauguacugggucagcugcgggaccggcaacaucguguccgccgugaacaugacgagccgcaugcuccugaaccgcuucaccauggcccaccggaagcccaccuacgagcgcgacgucgaccugggggccggcacccggcacguggccguggagcccgaggucgcgaaccucgacaucaucggccagcgcaucgagaacaucaagaacgagcacaaguccacguggcacuacgacgaggacaacccguacaagaccugggccuaccacgggagcuacgaggugaagcccuccggcagcgccuccagcauggugaacggggucgugcggcugcugaccaagcccugggacgucauccccauggugacccagaucgccaugacggacaccaccccguucggccagcagcgcguguucaaggagaaggucgacacccggacgccccgcgccaagcgggggaccgcgcagaucauggaggugaccgccaaguggcucuggggcuuccugucccgcaacaagaagccccggaucugcacccgcgaggaguucacgcggaaggugcgcagcaacgccgccaucggcgccgucuucguggacgagaaccaguggaacagcgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggcgaucugguacauguggcugggcgcccgcuuccucgaguucgaggcccugggcuucaugaacgaggaccacugguucagccgggagaacuccuucagcgggguggagggcgaggggcugcacaagcucggcuacauccugcgcgacaucuccaagauccccgggggcaacauguacgccgacgacaccgccggcugggacacccgcaucacggaggacgaccugcagaacgaggcgaagaucaccgacaucauggagcccgagcacgcccuccuggccaccagcaucuucaagcugaccuaccagaacaaggucgugcgggugcagcgccccgccaagaacgggacggucauggacgugaucucccggcgcgaccagcggggcagcggccagguggggaccuacggccucaacaccuucaccaacauggagguccagcugauccgccagauggaguccgaggggaucuuccugcccagcgagcucgagacgccgaaccuggccgagcgggugcuggacuggcucgagaagcacggcaccgagcgccugaagcggauggcgaucuccggggacgacugcguggucaagcccguggacgaccgcuucgccaccgcccugaucgcccucaacgacaugggcaaggugcggaaggacaucccccagugggagcccagcaagggguggaacgacuggcagcaggucccguucugcucccaccacuuccaccagcugaucaugaaggacggccgcgagaucguggugcccugccggaaccaggacgagcuggucggccgcgcccgggugagccagggggcgggcuggucccuccgcgagaccgccugccugggcaagagcuacgcccagauguggcagcugauguacuuccaccggcgcgaccuccggcuggccgccaacgcgaucugcuccgccgugcccgucgacugggugcccacgagccgcaccaccuggagcauccacgcccaccaccaguggaugaccaccgaggacaugcuguccguguggaaccgcgucuggaucgaggagaacccguggauggaggacaagacgcacgugagcuccugggaggaggugcccuaccucggcaagcgggaggaccaguggugcgggagccugaucggccugaccgcccgcgcgaccugggccaccaacauccaggucgccaucaaccaggugcggcgccucaucggcaacgagaacuaccuggacuacaugacguccaugaagcgguucaagaacgagagcgaccccgagggggcccugugguga

SEQ ID NO: 8221 - RNA, 9879 nt, Artificial Sequence
  derived and/or modified CDS sequence (opt1) from DENV-1__FJ547087__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucauggugggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccgccagccuguccaugaccugcaucgccgucgggauggugacccuguaccucggcgugaugguccaggccgacagcgggugcgugaucaacuggaagggccgcgagcugaagugcggguccggcaucuucgugaccaacgagguccacacguggaccgagcaguacaaguuccaggcggacagcccgaagcggcugagcgccgccaucggcaaggccugggaggagggggugugcggcauccgcuccgccacccggcucgagaacaucauguggaagcagaucagcaacgagcugaaccacauccugcucgagaacgacaugaaguucaccguggucgugggggacgcgaacggcauccuggcccaggggaagaagaugauccgcccccagcccauggagcacaaguacuccuggaaguccuggggcaaggccaagaucaucggcgccgacauccagaacaccacguucaucaucgacgggcccgacaccccggagugccccgacgaccagcgggcguggaacaucugggagguggaggacuacggcuucgggaucuucaccaccaacaucuggcugaagcuccgcgacuccuacacgcagaugugcgaccaccggcugaugagcgccgccaucaaggacuccaaggccguccacgccgacaugggcuacuggaucgagagcgagaagaacgagaccuggaagcuggcgcgcgccuccuucaucgaggugaagaccugcaucuggcccaagagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucgaccugugcgagggcaccaccgucgugguggacgagcacugcggcaaccgcgggccgagccuccggacgaccaccgucaccggcaagaucauccacgaguggugcugccgcuccugcacgcugccgccccugcgguuccgcggggaggacggcugcugguacgggauggagauccggcccgugaaggagaaggaggagaaccucgugcgcagcauggucuccgccggcagcggcgagguggacagcuucucccuggggauccugugcgugagcaucaugaucgaggaggucaugcggucccgcuggagccggaagaugcucaugaccggcacccuggccguguuccugcuccugaucauggggcagcugaccuggaacgaccucauccgccugugcaucauggugggcgcgaacgccuccgaccgcauggggaugggcacgaccuaccuggcccucauggccaccuucaagaugcggccgauguucgccgucgggcugcuguuccgccggcucaccagccgcgaggugcugcugcucacgaucgggcugucccugguggcgagcgucgagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccauggccauggugcugagcaucgucucccuguucccccucugccugagcacgaccucccagaagaccaccuggcugccggugcuccugggcagcuucgggugcaagccccugacgauguuccucaucaccgagaacaagaucuggggccggaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgcgacgacacccucacgauccugcugaaggccacccuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacacgauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggcgaucgcccuggacuucaagcccggcaccagcggguccccgaucgugaaccgggagggcaagaucgucggccuguacgggaacggcguggugacgaccagcgggaccuacgucuccgccaucgcccaggccaaggcgagccaggacggcccccuccccgagaucgaggacgagguguucaagaagcgcaaccugaccaucauggaccugcacccggggagcggcaagacgcggcgcuaccuccccgccaucgugcgggaggccaucaagcgcaagcugcggacccugauccucgcccccacccgcgucguggcguccgagauggccgaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcgcacuucacggaccccgccagcaucgccgcccgcggcuacaucuccacccgggucgggaugggcgaggccgcggccaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgcgaacugccugcgcaagaacggcaagcgggugauccagcucagccgcaagaccuucgacaccgaguaccagaagacgaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugaccgucgcgagcgccgcccagcgccggggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgugagcggcgaccugauccucgagaucggcaagcugccccagcaccugaccauccgggcccagaacgcgcucgacaaccuggucaugcugcacaacuccgagcagggcgggaaggccuaccgccacgccauggaggagcuccccgacaccaucgagacccugaugcugcucgcccugaucgcggugcugaccgggggcgugacccucuucuuccugagcgggaagggccugggcaagaccuccaucgggcuccugugcgucauggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucggccuccuguucaugauccugaccguggccgccaacgagauggggcuccuggagacgaccaagaaggaccugggcaucgggcacgucgccgcggagaaccaccaccacgccaccaugcucgacguggaccugcggccggccagcgccuggacccuguacgccguggcgacgaccgucaucacccccaugaugcgccacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggugaacccgcucacccugacggccgccguccugaugcucguggcgcacuacgccaucaucgggcccggccugcaggccaaggccacccgggaggcccagaagcgcaccgcggccgggaucaugaagaaccccaccguggacggcaucgucgccaucgaccuggaccccgugguguacgacgccaaguucgagaagcagcucggccagaucaugcugcugauccucugcacgagccagauccugcugaugcgcaccaccugggcccucugcgaguccaucacccuggcgacggggccgcugaccacccucugggagggcagccccgggaaguucuggaacaccacgaucgccgucuccauggccaacaucuuccggggcagcuaccuggccggcgccgggcuggcguucucccucaugaagucccugggcgggggccgccgggggaccggcgcccagggcgagacccugggggagaaguggaagcgccagcucaaccagcuguccaagagcgaguucaacaccuacaagcggagcggcaucauggagguggaccgcuccgaggccaaggaggggcugaagcggggcgagacgaccaagcacgccgugagccgcgggaccgcgaagcuccggugguucgucgagcgcaaccuggugaagcccgagggcaaggugaucgaccugggcugcgggcggggcgggugguccuacuacugcgccggccugaagaaggucaccgaggugaagggguacacgaagggcggccccgggcacgaggagccgauccccauggccaccuacggcuggaaccucgugaagcugcacagcgggaaggacgucuucuucacgccgcccgagaagugcgacacccugcucugcgacaucggcgaguccagcccgaaccccaccaucgaggaggggcgcacgcugcgggugcugaagaugguggagcccuggcuccgcggcaaccaguucugcaucaagauccugaaccccuacaugccguccgucguggagacccuggagcagaugcagcggaagcacggcgggaugcucgugcgcaacccccugagccggaacuccacccacgagauguacugggucagcugcggcaccgggaacaucguguccgccgugaacaugacgagccgcaugcugcucaaccgguucaccauggcccaccgcaagcccaccuacgagcgcgacgucgaccugggcgcgggcacccggcacguggccguggagcccgaggucgccaaccuggacaucaucgggcagcgcaucgagaacaucaagaacgagcacaaguccacguggcacuacgacgaggacaacccguacaagaccugggccuaccacggcagcuacgaggugaagcccuccgggagcgccuccagcauggugaacggcgucgugcggcuccugaccaagcccugggacgucauccccauggugacccagaucgcgaugacggacaccaccccguucgggcagcagcgcguguucaaggagaaggucgacacccggacgccccgcgccaagcggggcaccgcccagaucauggaggugaccgccaaguggcuguggggcuuccucucccgcaacaagaagccccggaucugcacccgcgaggaguucacgcggaaggugcgcagcaacgccgcgaucggggccgucuucguggacgagaaccaguggaacagcgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgcggacgacaccgccgggugggacacccggaucacggaggacgaccugcagaacgaggccaagaucaccgacaucauggagcccgagcacgcccuccuggccaccagcaucuucaagcugaccuaccagaacaaggucgugcgcgugcagcgccccgcgaagaacggcacggucauggacgugaucucccggcgcgaccagcgggggagcggccaggugggcaccuacgggcucaacaccuucaccaacauggagguccagcugauccgccagauggaguccgagggcaucuuccugcccugcgagcucgagacgccgaaccuggccgagcgggugcuggacuggcucgagaagcacggggccgagcgccugaagcggauggccaucagcggcgacgacugcguggucaagcccaucgacgaccgcuucgccaccgcgcugaucgcccucaacgacauggggaaggugcggaaggacaucccccagugggagcccuccaagggcuggaacgacuggcagcaggucccguucugcagccaccacuuccaccagcugaucaugaaggacggccgcgagaucgucgugcccugccggaaccaggacgagcugguggggcgcgcccgggucucccagggcgccggguggagccuccgcgagaccgccugccugggcaaguccuacgcgcagauguggcagcugauguacuuccaccggcgcgaccuccggcuggccgccaacgccaucugcagcgcggugcccguggacuggguccccaccucccgcacgaccuggagcauccacgcccaccaccaguggaugaccaccgaggacaugcugagcguguggaaccggguguggaucgaggagaacccguggauggaggacaagacccacgucuccagcugggaggaggugcccuaccucgggaagcgcgaggaccaguggugcggcucccugaucggccugacggcccgcgccaccugggccaccaacauccagguggcgaucaaccagguccggcgccucaucgggaacgagaacuaccuggacuacaugaccagcaugaagcgguucaagaacgaguccgaccccgagggcgcccugugguga

SEQ ID NO: 8222 - RNA, 9879 nt, Artificial Sequence
  derived and/or modified CDS sequence (opt1) from DENV-1__FJ410186__SS-prME
agcgugaccaugcugcucaugcugcugcccaccgcccucgccuuccaccugaccacccggggcggggagccccacaugaucgugagcaagcaggagcggggcaagagccuccucuucaagaccagcgccggggugaacaugugcacccugaucgccauggaccugggcgagcucugcgaggacaccaugaccuacaagugcccccggaucaccgagguggagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgccuucuuccuggcccacgcgaucggcaccagcaucacccagaaggggaucaucuucauccuccugaugcuggugacccccuccauggccaugcgcugcgugggcaucggcaaccgggacuucguggaggggcucagcggcgccacgugggucgacguggugcuggagcacggguccugcgucaccaccauggccaagaacaagcccacccuggacaucgagcuccugaagacggaggugaccaaccccgccgugcugcgcaagcucugcaucgaggcgaagaucagcaacaccaccacggacucccggugccccacccagggcgaggccacccuggucgaggagcaggacgccaacuucgugugccgccggaccuucguggaccgcggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccgccaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccggcugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccgccugaucacggccaacccgaucgugaccgacaaggagaagcccgugaacaucgagaccgagccgcccuucggggagagcuacaucaucgucggcgccggcgagaaggcccucaagcuguccugguucaagaaggggagcuccaucggcaagauguucgaggcgaccgcccgcggggcccgccggauggccauccugggcgacacggccugggacuucgggagcaucggcggcguguucaccuccguggggaagcucguccaccagguguucggcaccgcguacggggugcuguucagcggcgucuccuggaccaugaagaucgggaucggcauccugcucacguggcugggccugaacagccgcuccgccagccucuccaugaccugcaucgccguggggauggugacccuguaccugggcgucauggugcaggccgacagcgggugcgugaucaacuggaagggccgcgagcucaagugcggguccggcaucuucgucaccaacgaggugcacacguggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacaccacguucaucaucgacgggcccgacaccccggagugccccgacgaccagcgggccuggaacaucugggaggucgaggacuacggcuucgggaucuucaccaccaacaucuggcugaagcugcgcgacuccuacacgcagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcaucuggcccaagagccacacccugugguccaacggcguccucgagagcgagaugaucauccccaagaucuacgggggcccgacgucccagcacaacuaccggcccggguacuucacccagaccgccggccccuggcaccuggggaagcuggagcucgacuucgaccugugcgagggcaccacggugguggucgacgagcacugcggcaaccgcgggccgagccugcggaccaccaccgugacgggcaagaucauccacgaguggugcugccgcuccugcacccugccgccccugcgguuccgcggggaggacggcugcugguacgggauggagauccggcccgugaaggagaaggaggagaaccugguccgcagcaugguguccgccggcagcggcgagguggacagcuucucccucgggauccugugcgucagcaucaugaucgaggaggugaugcggucccgcuggagccggaagaugcugaugaccggcacccucgccguguuccugcugcucaucauggggcagcugacguggaacgaccugauccgccucugcaucauggucggcgccaacgcguccgaccgcauggggaugggcaccaccuaccuggcccugauggccaccuucaagaugcggccgauguucgccgugggccuccuguuccgccggcugacgagccgcgaggugcuccugcugaccaucgggcucucccuggucgccagcguggagcugcccaacucccucgaggagcugggcgacgggcuggcgaugggcaucaugaugcucaagcugcugaccgaguuccagccccaccagcucuggaccacgcugcugagccucaccuucaucaagaccacccugucccuggacuacgccuggaagacgauggccaugguccucagcaucgugucccuguucccccugugccucagcaccaccucccagaagaccacguggcugccggugcugcucggcagcuucgggugcaagccccugaccauguuccugaucaccgagaacaagaucuggggccggaaguccuggccccucaacgaggggaucauggccaucggcaucgucagcauccugcuguccagccuccugaagaacgacgugccccuggcggggccgcucaucgccggcggcaugcugaucgccugcuacgugaucagcggguccagcgccgaccugucccucgagaaggccgcggaggucagcugggaggaggaggccgagcacuccggcaccagccacaacauccugguggaggugcaggacgacgggaccaugaagaucaaggacgaggagcgcgacgacacgcugaccauccuccugaaggccacccugcucgccgucuccggcguguaccccaugagcauccccgccacccuguucgugugguacuucuggcagaagaagaagcagcgguccgggguccugugggacacgcccagcccgcccgagguggagcgcgcggugcucgacgacggcaucuaccggauccugcagcgcggccugcuggggcggucccaggucggcguggggguguuccaggacggcgucuuccacaccauguggcacgugacccgcggggccgugcucauguaccagggcaagcggcuggagcccagcugggccuccgucaagaaggaccugaucagcuacggcgggggcuggcgcuuccaggggcucuggaacaccggcgaggagguccaggugaucgccgucgagcccgggaagaacccgaagaacgugcagacgacccccggcaccuucaagacccccgagggcgaggugggggccaucgcgcuggacuucaagcccggcacguccgggagcccgaucgucaaccgggagggcaagaucgugggccuguacgggaacggcguggucaccaccuccgggaccuacgugagcgccaucgcccaggccaaggccucccaggagggcccccuccccgagaucgaggacgagguguucaagaagcgcaaccugacgaucauggaccugcacccggggagcggcaagacccggcgcuaccuccccgcgaucguccgggaggccaucaagcgcaagcugcggacccugauccucgcccccacccgcgugguggccagcgagauggcggaggcccugaagggcaugcccauccgcuaccagacgaccgccgucaaguccgagcacaccgggcgggagaucguggaccugaugugccacgccaccuucacgaugcgccuccugagcccggugcggguccccaacuacaacaugaucaucauggacgaggcccacuucaccgaccccgcguccaucgccgcccgcggcuacaucagcacccggguggggaugggcgaggccgccgcgaucuucaugaccgccacgcccccgggguccguggaggccuucccccagagcaacgccgucauccaggacgaggagcgcgacauccccgagcgguccuggaacagcggcuacgacuggaucaccgacuuccccggcaagaccgugugguucgugccguccaucaagagcgggaacgacaucgccaacugccugcgcaagaacggcaagcgggucauccagcucucccgcaagaccuucgacacggaguaccagaagaccaagaacaacgacugggacuacguggugaccaccgacaucagcgagaugggggcgaacuuccgggccgaccgcgucaucgacccccggcgcugccugaagcccgugauccugaaggacggccccgagcgggugauccucgccgggccgaugcccgucacgguggccuccgcggcccagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcccuguucgagcccgagcgcgagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggacgaaggagggcgagcgcaagaagcugcggccccgcuggcuggacgcccggaccuacagcgacccgcucgcgcugcgcgaguucaaggaguucgccgccgggcggcgcuccgucagcggcgaccugauccucgagaucggcaagcugccccagcaccugacccuccgggcccagaacgcccuggacaaccuggugaugcuccacaacagcgagcagggcgggaaggcguaccgccacgccauggaggagcugcccgacaccaucgagacccugaugcuccuggcccugaucgccgugcucaccgggggcgucacccuguucuuccuguccgggaagggccucggcaagaccagcaucgggcugcugugcgugauggcguccagcgcccuccuguggauggccuccguggagccccacuggaucgccgccagcaucauccuggaguucuuccucaugguccugcugaucccggagcccgaccggcagcgcacgccccaggacaaccagcucgcguacguggugaucggccugcuguucaugauccucacggucgccgccaacgagauggggcugcuggagaccaccaagaaggaccucggcaucgggcacguggccgccgagaaccaccaccacgcgaccaugcuggacguggaccugcggccggccuccgccuggacgcucuacgccgucgccaccaccgugaucacccccaugaugcgccacacgaucgagaacaccaccgcgaacaucagccugaccgccaucgccaaccaggccgccauccugaugggccucgacaagggcuggcccaucuccaagauggacaucggggugccccugcuggcgcucggcugcuacagccaggucaacccgcugacgcugaccgccgccgugcucaugcugguggcccacuacgcgaucaucgggcccggccugcaggcccgggccacccgcgaggcccagaagcgcaccgccgcggggaucaugaagaaccccacggucgacggcaucguggccaucgaccucgaccccguggucuacgacgccaaguucgagaagcagcugggccagaucaugcugcucauccugugcaccucccagauccugcucaugcggaccaccugggcccugugcgagagcaucacgcuggccaccgggccgcucaccacccugugggagggcucccccgggaaguucuggaacacgaccaucgcggugagcauggccaacaucuuccgcggcuccuaccuggccggcgccgggcucgccuucagccugaugaagucccugggcgggggccggcgcgggaccggcgcgcagggcgagacccucggggagaaguggaagcggcagcugaaccagcugagcaaguccgaguucaacacguacaagcgcagcggcaucauggagguggaccggagcgaggccaaggaggggcucaagcgcggcgagaccaccaagcacgccgucucccgggggaccgccaagcugcgcugguucguggagcggaaccuggugaagcccgagggcaaggucaucgaccugggcugcgggcgcggcggguggagcuacuacugcgcgggccucaagaaggugacggaggugaagggguacaccaagggcggccccgggcacgaggagccgauccccauggccaccuacggcuggaaccuggucaagcugcacuccgggaaggacguguucuucacgccgcccgagaagugcgacacccuccugugcgacaucggcgagagcuccccgaaccccacgaucgaggaggggcggacccugcgcgugcucaagauggucgagcccuggcugcggggcaaccaguucugcaucaagauccugaaccccuacaugccgagcgugguggagacccucgagcagaugcagcgcaagcacggcgggaugcugguccggaacccccugucccgcaacagcacccacgagauguacuggguguccugcggcacggggaacaucgugagcgccgucaacaugaccucccggaugcuccugaaccgcuucaccauggcccaccgcaagcccaccuacgagcgggacguggaccugggcgccggcacgcgccacguggcggucgagcccgagguggccaaccucgacaucaucgggcagcggaucgagaacaucaagaacgagcacaagagcaccuggcacuacgacgaggacaacccguacaagaccugggccuaccacggcuccuacgaggugaagcccagcggguccgccagcuccauggucaacggcgugguccgccugcugaccaagcccugggacgugauccccauggugacgcagaucgccaugaccgacaccaccccguucgggcagcagcgggucuucaaggagaagguggacacgcgcacgccccgggcgaagcgcggcaccgcccagaucauggaggugaccgccaaguggcucuggggcuuccugagccggaacaagaagccccgcaucugcacgcgggaggaguucacccgcaagguccgguccaacgccgccaucggggcgguguucguggacgagaaccaguggaacagcgccaaggaggccgucgaggacgagcgcuucugggaccuggugcggcgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagaucccgggcggcaacauguacgccgacgacaccgcggggugggacacgcgcaucaccgaggacgaccuccagaacgaggccaagaucaccgacaucauggagcccgagcacgcccugcuggccaccuccaucuucaagcucacguaccagaacaagguggugcggguccagcgccccgccaagaacggcaccgugauggacgugaucagccggcgcgaccagcggggguccggccaggucggcaccuacgggcugaacaccuucacgaacauggaggugcagcugauccgccagauggagagcgagggcaucuuccuccccuccgagcuggagaccccgaaccuggcggagcgggugcucgacuggcuggagaagcacggggccgagcgccugaagcggauggccaucagcggcgacgacugcgucgugaagcccguggacgaccgcuucgccaccgcccucaucgcgcugaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcucguggggcgcgcccgggugucccagggcgccggguggagccugcgcgagaccgccugccugggcaaguccuacgcccagauguggcagcucauguacuuccaccggcgcgaccugcggcuggcggccaacgccaucugcagcgccgaccccgucgacugggugcccacgucccgcaccaccuggagcauccacgcgcaccaccaguggaugaccaccgaggacaugcucagcguguggaaccgcgucuggaucgaggagaacccguggauggaggacaagacgcacguguccagcugggaggaggugcccuaccuggggaagcgggaggaccaguggugcggcucccugaucggccucaccgcccgcgccaccugggccaccaacauccaggucgccaucaaccaggugcggcgccugaucgggaacgagaacuaccuggacuacaugaucagcaugaagcgguucaagaacgaguccgaccccgagggcgcgcucugguga

SEQ ID NO: 8223 - RNA, 9879 nt, Artificial Sequence
  derived and/or modified CDS sequence (opt1) from DENV-1__FJ410187__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggccguguuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccgucgggcugcuguuccggcgccucaccagccgggaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcgcaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgcgacgacacccucaccauccugcugaaggccacgcuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacaccauguggcacgucacgcgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacccccggcacguucaagacccccgagggcgaggugggggcgaucgcccuggacuucaagcccggcaccagcggguccccgaucgugaaccgggagggcaagaucgucggccuguacgggaacggcguggugaccacgagcgggaccuacgucagcgccaucgcccaggccaagaccucccaggagggcccccuccccgagaucgaggaggagguguucaagaagcgcaaccugaccaucauggaccugcacccggggagcggcaagacgcggcgcuaccuccccgcgaucgugcgggaggccaucaagcgcaagcugcgcacccugauccucgcccccacccgggucguggccuccgagauggcggaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcccacuucacggaccccgcgagcaucgccgcccgcggcuacaucuccacccgggucgggaugggcgaggccgccgcgaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgcggaacaacgacugggacuacgucgugaccaccgacaucuccgagaugggggcgaacuuccgcgccgaccgggugaucgacccccgccggugccugaagcccgucauccugaaggacggccccgagcgcgugauccucgccgggccgaugcccgugaccgucgccagcgcggcccagcggcgcggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcacguacagcgacccgcucgcgcugcgggaguucaaggaguucgccgccgggcgccgguccgugagcggcgaccugauccucgagaucggcaagcugccccagcaccugacccuccgcgcccagaacgcccuggacaaccuggucaugcuccacaacuccgagcagggcgggaaggcguaccggcacgccauggaggagcugcccgacaccaucgagacccugaugcuccuggcccugaucgccgugcucaccgggggcgugacgcuguucuuccugagcgggaagggccucggcaagaccuccaucgggcugcugugcgucauggcgagcuccgcccuccuguggauggccaacguggagccccacuggaucgccgccagcaucauccuggaguucuuccucauggugcugcugaucccggagcccgaccgccagcggacgccccaggacaaccagcucgcguacgucgugaucggccugcuguucaugauccucaccguggccgccaacgagauggggcugcuggagacgaccaagaaggaccucggcaucgggcacgucgccgccgagaaccagcaccacgcgaccaugcuggacguggaccugcgcccggccuccgccuggacccucuacgccguggccacgaccgucaucacccccaugaugcgccacaccaucgagaacacgaccgcgaacaucagccugaccgccaucgccaaccaggccgccauccugaugggccucgacaagggcuggcccaucuccaagauggacaucggggugccccugcuggcgcucggcugcuacagccaggugaacccgcugacccugacggccgccguccucaugcugguggcccacuacgcgaucaucgggcccggccugcaggccaaggccacccgggaggcccagaagcgcaccgccgcggggaucaugaagaaccccaccguggacggcaucgucgccaucgaccucgaccccgugguguacgacgccaaguucgagaagcagcugggccagaucaugcugcucauccugugcacgucccagauccugcucaugcggaccaccugggcccugugcgagagcaucacccuggccacggggccgcucaccacccugugggagggcucccccgggaaguucuggaacaccacgaucgcggucagcauggccaacaucuuccgcggcuccuaccuggccggcgccgggcucgccuucagccugaugaagucccugggcgggggccggcgcgggaccggcgcgcagggcgagacccucggggagaaguggaagcggcagcugaaccagcugagcaagagcgaguucaacaccuacaagcgcuccggcaucauggagguggaccggagcgaggccaaggaggggcucaagcgcggcgagacgaccaagcacgccgugucccgggggaccgccaagcugcgcugguucgucgagcggaaccuggugaagcccgagggcaaggugaucgaccugggcugcgggcgcggcggguggagcuacuacugcgcgggccucaagaaggucaccgaggugaagggguacacgaagggcggccccgggcacgaggagccgauccccauggccaccuacggcuggaaccuggugaagcuguacuccgggaaggacgucuucuucacgccgcccgagaagugcgacacccuccugugcgacaucggcgagagcuccccgaaccccaccaucgaggaggggcggacgcugcgcgugcucaagaugguggagcccuggcugcggggcaaccaguucugcaucaagauccugaaccccuacaugccgagcgucguggagacccucgagcagaugcagcgcaagcacggcgggaugcuggugcggaacccccugucccgcaacagcacccacgagauguacugggucuccugcggcaccgggaacaucgugagcgccgugaacaugacgucccgcaugcuccugaaccgguucaccaugacccaccgcaagcccaccuacgagcgggacgucgaccugggcgccggcacgcgccacguggccguggagcccgaggucgcgaaccucgacaucaucgggcagcggaucgagaacaucaagaacgagcacaagagcaccuggcacuacgacgaggacaacccguacaagaccugggccuaccacggcuccuacgaggugaagcccagcggguccgccagcuccauggugaacggcgucgugcgccugcugaccaagcccugggacgucauccccauggugacgcagaucgccaugaccgacaccaccccguucgggcagcagcggguguucaaggagaaggucgacacgcgcacgccccgggccaagcgcggcaccgcgcagaucauggaggugaccgccaaguggcucuggggcuuccugagccggaacaagaagccccgcaucugcacgcgggaggaguucacccgcaaggugcggagcaacgccgccaucggggccgucuucguggacgagaaccaguggaacuccgcgaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagcuucuccggcguggagggggagggccugcacaagcucggguacauccugcgcgacaucagcaagaucccgggcggcaacauguacgccgacgacaccgccgggugggacacgcggaucaccgaggacgaccugcagaacgaggcgaagaucaccgacaucauggagcccgagcacgcccuccuggccaccuccaucuucaagcugacguaccagaacaaggucgugcgcgugcagcggcccgccaagaacggcaccgucauggacgugaucagccgccgggaccagcgcggguccggccaggugggcaccuacgggcucaacaccuucacgaacauggagguccagcugauccggcagauggagagcgagggcaucuuccugcccuccgagcucgagaccccgaaccuggccgagcgcgugcuggacuggcucgagaagcacgggaccgagcggcugaagcgcauggcgaucagcggcgacgacugcguggucaagcccguggacgaccgguucgccaccgcccugaucgcccucaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcuggucgggcgggcccgcgugucccagggcgcgggguggagccuccgggagacggccugccugggcaaguccuacgcccagauguggcagcugauguacuuccaccgccgggaccuccgccuggccgccaacgcgaucugcagcgccgugcccgucgacugggugcccaccagccgcaccaccugguccauccacgcccaccaccaguggaugaccacggaggacaugcugagcguguggaaccgggucuggaucgaggagaacccguggauggaggacaagacccacguguccagcugggaggaggugcccuaccucgggaagcgcgaggaccaguggugcggcucccugaucggccugaccgcccgggcgaccugggccacgaacauccaggucgccaucaaccaggugcgccggcucaucgggaacgagaacuaccuggacuacaugaccagcaugaagcgcuucaagaacgaguccgaccccgagggcgcccugugguga

SEQ ID NO: 8224 - RNA, 9879 nt, Artificial Sequence
  derived and/or modified CDS sequence (opt1) from DENV-1__FJ478457__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccagcacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcauguucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgcgagcugaagugcggguccggcaucuucgugacgaacgagguccacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccguggucgugggggacgccuccggcauccuggcgcaggggaagaagaugauccgcccccagcccauggagcacaaguacagcuggaaguccuggggcaaggccaagaucaucggcgccgacauccagaacacgaccuucaucaucgacgggcccgacaccccggagugcagcgacgaccagcgggccuggaacaucugggagguggaggacuacggcuucgggaucuucaccacgaacaucuggcugaagcuccgcgacuccuacacccagaugugcgaccaccggcugaugagcgcggccaucaaggacuccaaggccguccacgccgacaugggcuacuggaucgagagcgagaagaacgagaccuggaagcuggcccgcgcguccuucaucgaggugaagaccugcaucuggcccaagagccacacgcucugguccaacggcgugcuggagagcgagaugaucauccccaagaucuacgggggccccaucucccagcacaacuaccggccgggguacuucacccagaccgccggccccuggcaccuggggaagcucgagcuggacuucgaccugugcgagggcaccacggucaucguggacgagcacugcggcaaccgcgggcccagccuccggaccaccaccgugacgggcaagaucauccacgaguggugcugccgcuccugcacccugccgccccugcgguuccgcggggaggacggcugcugguacgggauggagauccggcccgucaaggagaaggaggagaaccucgugcgcagcauggugagcgccggcuccggcgaggucgacagcuucucccuggggauccugugcgugagcaucaugaucgaggaggugaugcggucccgcuggagccggaagaugcucaugaccggcacccuggccgucuuccugcuccugaucauggggcagcugacguggaacgaccucauccgccugugcaucauggugggcgccaacgcguccgaccgcauggggaugggcaccaccuaccuggcccucauggccaccuucaagaugcggcccauguucgccgugggccugcuguuccgccggcucacgagccgcgagguccugcugcucaccaucgggcugucccugguggccagcguggagcucccgaacucccuggaggagcugggcgacgggcucgcgaugggcaucaugaugcugaagcugcucaccgaguuccagccccaccagcuguggaccacgcugcucagccugaccuucaucaagaccacccugucccucgacuacgccuggaagacgauggccauggcccugagcaucgucucccuguucccccucugccugagcaccaccucccagaagaccacguggcugcccgugcuccugggcagcuucgggugcaagccgcugaccauguuccucaucaccgagaacaagaucuggggccggaaguccuggccccugaacgaggggaucauggcgaucggcaucgucagcauccugcucagcucccugcugaagaacgacgugccccucgccgggccccugaucgccggcggcaugcugaucgccugcuacgugaucagcggguccagcgccgaccucucccuggagaaggcggccgaggucagcugggaggaggaggccgagcacuccggcaccagccacaacaugcugguggaggugcaggacgacgggaccaugaagaucaaggacgaggagcgcgacgacacgcucaccauccugcugaaggccacccuccuggccgucuccggcguguacccgaugagcauccccgcgacccuguucgugugguacuucuggcagaagaagaagcagcgguccgggguccucugggacacgcccagcccgcccgagguggagcgcgccgugcuggacgacggcaucuaccggauccugcagcgcggccugcucgggcggucccaggucggcguggggguguuccaggacggcgucuuccacaccauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaaccccaagaacgugcagacgacccccggcaccuucaagacccccgagggcgaggugggggcgaucgcccuggacuucaagcccggcacgagcgggucccccaucgucaaccgggagggcaagaucgugggccuguacgggaacggcguggucaccaccagcgggaccuacgugagcgccaucgcccaggccaaggcgucccaggagggcccgcuccccgagaucgaggacgagguguuccgcaagcggaaccugacgaucauggaccugcaccccgggagcggcaagacccgccgguaccucccggccaucguccgcgaggccaucaagcggaagcugcgcacccugauccucgcccccacccgcgugguggcguccgagauggccgaggcccugaagggcaugcccauccgguaccagacgaccgccgucaagagcgagcacaccgggcgcgagaucguggaccugaugugccacgccaccuucacgaugcggcuccugucccccgugcgcgucccgaacuacaacaugaucaucauggacgaggcgcacuucaccgaccccgccagcaucgccgcccggggcuacaucuccacccgcguggggaugggcgaggccgcggccaucuucaugaccgccacgccgcccgggagcguggaggccuucccgcaguccaacgccgucauccaggacgaggagcgggacauccccgagcgcagcuggaacuccggcuacgacuggaucaccgacuuccccggcaagaccgugugguucgugcccagcaucaaguccgggaacgacaucgcgaacugccugcggaagaacggcaagcgcgucauccagcucagccggaagaccuucgacacggaguaccagaagaccaagaacaacgacugggacuacguggugaccaccgacaucuccgagaugggggccaacuuccgcgccgaccgggucaucgacccgcgccggugccugaagcccgugauccugaaggacggccccgagcgcgugauccucgccgggcccaugccggucacgguggcgagcgccgcccagcggcgcggccggaucggccgcaaccagaacaaggagggggaccaguacguguacaugggccagccccugaacaacgacgaggaccacgcccacuggaccgaggccaagaugcugcucgacaacaucaacacccccgaggggaucauccccgcgcuguucgagccggagcgcgagaaguccgccgccaucgacggcgaguaccggcugcgcggggaggcccggaagaccuucgucgagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggacgaaggagggcgagcggaagaagcugcgcccccgguggcuggacgcgcgcaccuacagcgacccccucgcccugcgggaguucaaggaguucgccgccgggcgccgguccgucagcggcgaccugauccucgagaucggcaagcugccgcagcaccugacccuccgcgcccagaacgcgcuggacaaccuggugaugcuccacaacuccgagcagggcgggaaggccuaccggcacgccauggaggagcugcccgacaccaucgagacccugaugcuccuggcccugaucgcggugcucaccggcggggucacccuguucuuccugagcgggaaggggcucggcaagaccuccaucgggcugcugugcgugauggccagcuccgcccuccuguggauggccagcguggagccccacuggaucgccgcguccaucauccuggaguucuuccucaugguccugcugauccccgagccggaccgccagcggacgccccaggacaaccagcucgccuacguggugaucggccugcuguucaugauccucacggucgccgccaacgagauggggcugcuggagaccaccaagaaggaccucggcaucgggcacguggccgcggagaaccaccaccacgccaccaugcuggacguggaccugcgccccgccagcgccuggacgcucuacgccgucgcgaccaccgugaucaccccgaugaugcggcacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggucaacccccugacgcugaccgccgccgugcucaugcugguggcgcacuacgccaucaucgggccgggccugcaggccaaggccacccgcgaggcccagaagcgcaccgcggccgggaucaugaagaaccccacggucgacggcaucguggccaucgaccucgaccccguggucuacgacgccaaguucgagaagcagcugggccagaucaugcugcucauccugugcaccagccagauccugcucaugcggaccaccugggcccugugcgaguccaucacgcuggcgaccgggccccucaccacccugugggagggcagcccggggaaguucuggaacacgaccaucgccguguccauggccaacaucuuccgcggcagcuaccuggccggcgccgggcucgcguucucccugaugaagucccugggcgggggccggcgcgggaccggcgcccagggcgagacccucggggagaaguggaagcggcagcugaaccagcugagcaaguccgaguucaacacguacaagcgcagcggcaucauggagguggaccgguccgaggccaaggaggggcucaagcgcggcgagaccaccaagcacgccgucagccgggggaccgcgaagcugcgcugguucguggagcggaaccuggugaagcccgagggcaaggucaucgaccugggcugcgggcgcggcgggugguccuacuacugcgccggccucaagaaggugacggaggugaagggguacaccaagggcggccccgggcacgaggagcccaucccgauggccaccuacggcuggaaccuggucaagcugcacagcgggaaggacguguucuucacgccgcccgagaagugcgacacccuccugugcgacaucggcgaguccagccccaacccgacgaucgaggaggggcggacccugcgcgugcucaagauggucgagcccuggcugcggggcaaccaguucugcaucaagauccugaaccccuacaugcccuccgugguggagacccucgagcagaugcagcgcaagcacggcgggaugcugguccggaacccgcugagccgcaacuccacccacgagauguacugggugagcugcggcacggggaacaucguguccgccgucaacaugaccagccggaugcuccugaaccgcuucaccauggcccaccgcaagcccaccuacgagcgggacguggaccugggcgcgggcacgcgccacguggccgucgagcccgagguggccaaccucgacaucaucgggcagcggaucgagaacaucaagaacgagcacaaguccaccuggcacuacgacgaggacaaccccuacaagaccugggccuaccacggcagcuacgaggugaagccguccgggagcgccuccagcauggucaacggcguggugcgccugcugaccaagcccugggacgucauccccauggugacgcagaucgcgaugaccgacaccacccccuucgggcagcagcgggucuucaaggagaagguggacacgcgcaccccgcgggccaagcgcggcaccgcccaggugauggaggucaccgccaaguggcucuggggcuuccugagccggaacaagaagccccgcaucugcacgcgggaggaguucacccgcaaggugcgguccaacgccgcgaucggggccguguucgucgacgagaaccaguggaacagcgccaaggaggccguggaggacgagaaguucugggaccuggugcaccgcgagcgggagcuccacaagcagggcaagugcgcgaccugcgucuacaacaugauggggaagcgcgagaagaagcugggcgaguucgggaaggccaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgcggacgacaccgccgggugggacacgcggaucaccgaggacgaccuccagaacgaggccaagaucaccgacaucauggagccggagcacgcccugcuggccaccagcaucuucaagcucacguaccagaacaaggugguccgcgugcagcgccccgcgaagaacggcaccgugauggacgucaucucccggcgcgaccagcgggggagcggccaggugggcaccuacgggcugaacaccuucacgaacauggaggugcagcugauccgccagauggaguccgagggcaucuuccuccccagcgagcuggagacccccaaccuggccgagcggguccucgacuggcuggagaagcacgggaccgagcgccugaagcggauggccaucuccggcgacgacugcguggugaagccgaucgacgaccgcuucgccaccgcccucaucgcgcugaacgacauggggaagguccggaaggacaucccccagugggagcccagcaagggcuggaacgaguggcagcagguccccuucugcucccaccacuuccaccagcugaucaugaaggacggccgcgagaucguggucccgugccggaaccaggacgagcucguggggcgcgcccgggugagccagggcgccggguggucccugcgcgagacggccugccugggcaagagcuacgcccagauguggcagcucauguacuuccaccggcgcgaccugcggcuggcggccaacgccaucugcagcgccguccccguggacugggugcccaccucccgcaccaccuggagcauccacgcgcaccaccaguggaugaccacggaggacaugcucuccgucuggaaccggguguggaucgaggagaaccccuggauggaggacaagacccacgugagcuccugggaggaggucccguaccuggggaagcgcgaggaccaguggugcggcagccugaucggccucaccgcccgcgccaccugggccacgaacauccagguggccaucaaccaggugcggcgccugaucgggaacgagaacuaccuggacuacaugaccuccaugaagcgguucaagaacgagagcgaccccgagggcgcgcucugguga

SEQ ID NO: 8225 - RNA, 9879 nt, Artificial Sequence
  derived and/or modified CDS sequence (opt1) from DENV-1__FJ410188__SS-prME
agcgugaccaugcugcucaugcugcugcccaccgugcucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcagcacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccgccucaucacggccaacccgaucgugaccgacaaggagaagcccgugaacaucgagaccgagccgcccuucggggagagcuacaucgucgugggcgccggcgagaaggcccugaagcuguccugguucaagaaggggagcuccaucggcaagauguucgaggcgaccgcccgcggggcccgccggauggccauccucggcgacacggccugggacuucgggagcaucggcggcauguucaccuccguggggaagcugguccaccagguguucggcaccgcguacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgccgcgaucggcaaggccugggaggagggggugugcggcauccgcuccgccacccggcucgagaacaucauguggaagcagaucagcaacgagcugaaccacauccugcucgagaacgacaugaaguucaccgucguggugggggacgccuccggcauccuggcccaggggaagaagaugauccgcccccagcccauggagcacaaguacagcuggaaguccuggggcaaggcgaagaucaucggcgccgacauccagaacacgaccuucaucaucgacgggcccgacaccccggagugcagcgacgaccagcgggccuggaacaucugggaggucgaggacuacggcuucgggaucuucaccacgaacaucuggcugaagcuccgcgacuccuacacccagaugugcgaccaccggcugaugagcgccgcgaucaaggacuccaaggccgugcacgccgacaugggcuacuggaucgagagcgagaagaacgagaccuggaagcuggcccgcgccuccuucaucgaggugaagaccugcaucuggcccaagagccacacgcucugguccaacggcguccuggagagcgagaugaucauccccaagaucuacgggggccccaucucccagcacaacuaccggccgggguacuucacccagaccgcgggccccuggcaccuggggaagcucgagcuggacuucgaccugugcgagggcaccacggugaucguggacgagcacugcggcaaccgcgggcccagccuccggaccaccaccgucacgggcaagaucauccacgaguggugcugccgcuccugcacccugccgccccugcgguuccgcggggaggacggcugcugguacgggauggagauccggcccgugaaggagaaggaggagaaccucgugcgcagcauggucagcgccggcuccggcgagguggacagcuucucccuggggauccugugcgugagcaucaugaucgaggaggucaugcggucccgcuggagccggaagaugcucaugaccggcacccuggccguguuccugcuccugaucauggggcagcugacguggaacgaccucauccgccugugcaucauggugggcgccaacgccuccgaccgcauggggaugggcaccaccuaccuggcgcucauggccaccuucaagaugcggcccauguucgccgucggccugcuguuccgccggcucacgagccgcgaggugcugcugcucaccaucgggcugucccugguggccagcgucgagcucccgaacucccuggaggagcugggcgacgggcucgccaugggcaucaugaugcugaagcugcucaccgaguuccagccccaccagcuguggaccacgcugcucagccugaccuucaucaagaccacccugucccucgacuacgcguggaagacgauggccauggcccugagcaucgugucccuguucccccucugccugagcaccaccucccagaagaccacguggcugcccguccuccugggcagcuucgggugcaagccgcugaccauguuccucaucaccgagaacaagaucuggggccggaaguccuggccccugaacgaggggaucauggccaucggcaucgugagcauccugcucagcucccugcugaagaacgacgugccccucgcggggccccugaucgccggcggcaugcugaucgccugcuacgucaucagcggguccagcgccgaccucucccuggagaaggccgcggaggugagcugggaggaggaggccgagcacuccggcaccagccacaacaugcugguggagguccaggacgacgggaccaugaagaucaaggacgaggagcgcgacgacacgcucaccauccugcugaaggccacccuccuggccguguccggcguguacccgaugagcauccccgccacccuguucgucugguacuucuggcagaagaagaagcagcgguccggggugcucugggacacgcccagcccgcccgagguggagcgcgcgguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaaccccaagaacgugcagacgacccccggcaccuucaagacccccgagggcgaggucggggccaucgcgcuggacuucaagcccggcacgagcgggucccccaucgugaaccgggagggcaagaucgugggccuguacgggaacggcgucgugaccaccagcgggaccuacgugagcgccaucgcccaggccaaggccucccaggagggcccgcuccccgagaucgaggacgaggucuuccgcaagcggaaccugacgaucauggaccugcaccccgggagcggcaagacccgccgguaccucccggcgaucgugcgcgaggccaucaagcggaagcugcgcacccugauccucgcccccacccgcguggucgccuccgagauggcggaggcccugaagggcaugcccauccgguaccagacgaccgccgucaagagcgagcacaccgggcgcgagaucguggaccugaugugccacgccaccuucacgaugcggcuccugucccccguccgcgugccgaacuacaacaugaucaucauggacgaggcccacuucaccgaccccgcgagcaucgccgcccggggcuacaucuccacccgcguggggaugggcgaggccgccgcgaucuucaugaccgccacgccgcccgggagcgucgaggccuucccgcaguccaacgccgugauccaggacgaggagcgggacauccccgagcgcagcuggaacuccggcuacgacuggaucaccgacuuccccggcaagaccgugugguucguccccagcaucaaguccgggaacgacaucgccaacugccugcggaagaacggcaagcgcgugauccagcucagccggaagaccuucgacacggaguaccagaagaccaagaacaacgacugggacuacguggucaccaccgacaucuccgagaugggggcgaacuuccgcgccgaccgggugaucgacccgcgccggugccugaagcccgugauccugaaggacggccccgagcgcgucauccucgccgggcccaugccggugacgguggccagcgcggcccagcggcgcggccggaucggccgcaaccagaacaaggagggggaccaguacgucuacaugggccagccccugaacaacgacgaggaccacgcccacuggaccgaggccaagaugcugcucgacaacaucaacacccccgaggggaucauccccgcccuguucgagccggagcgcgagaaguccgcggccaucgacggcgaguaccggcugcgcggggaggcccggaagaccuucguggagcucaugcgccggggcgaccugcccgucuggcugagcuacaagguggccuccgagggcuuccaguacagcgaccgccgguggugcuucgacggggagcgcaacaaccaggugcucgaggagaacauggacgucgagaucuggacgaaggagggcgagcggaagaagcugcgcccccgguggcuggacgcccgcaccuacagcgacccccucgcgcugcgggaguucaaggaguucgccgccgggcgccgguccgugagcggcgaccugauccucgagaucggcaagcugccgcagcaccugacccuccgcgcccagaacgcccuggacaaccuggugaugcuccacaacuccgagcagggcgggaaggcguaccggcacgccauggaggagcugcccgacaccaucgagacccugaugcuccuggcccugaucgccguccucaccggcggggugacccuguucuuccugagcgggaaggggcucggcaagaccuccaucgggcugcugugcgugauggcgagcuccgcccuccuguggauggccagcgucgagccccacuggaucgccgccuccaucauccuggaguucuuccucauggugcugcugauccccgagccggaccgccagcggacgccccaggacaaccagcucgcguacguggucaucggccugcuguucaugauccucacgguggccgccaacgagauggggcugcuggagaccaccaagaaggaccucggcaucgggcacguggccgccgagaaccaccaccacgcgaccaugcuggacgucgaccugcgccccgccagcgccuggacgcucuacgccguggccaccaccgugaucaccccgaugaugcggcacacgaucgagaacaccaccgcgaacaucucccugaccgccaucgccaaccaggccgccauccugaugggccucgacaagggcuggcccaucagcaagauggacaucggggucccccugcuggcgcucggcugcuacucccaggugaacccccugacgcugaccgccgccgugcucaugcuggucgcccacuacgcgaucaucgggccgggccugcaggccaaggccacccgcgaggcccagaagcgcaccgccgcggggaucaugaagaaccccacgguggacggcaucguggccaucgaccucgaccccgucguguacgacgccaaguucgagaagcagcugggccagaucaugcugcucauccugugcaccagccagauccugcucaugcggaccaccugggcccugugcgaguccaucacgcuggccaccgggccccucaccacccugugggagggcagcccggggaaguucuggaacacgaccaucgcgguguccauggccaacaucuuccgcggcagcuaccuggccggcgccgggcucgccuucucccugaugaagucccugggcgggggccggcgcgggaccggcgcgcagggcgagacccucggggagaaguggaagcggcagcugaaccagcugagcaaguccgaguucaacacguacaagcgcagcggcaucauggaggucgaccgguccgaggccaaggaggggcucaagcgcggcgagaccaccaagcacgccgugagccgggggaccgccaagcugcgcugguucguggagcggaaccuggucaagcccgagggcaaggugaucgaccugggcugcgggcgcggcgggugguccuacuacugcgcgggccucaagaaggugacggaggucaagggguacaccaagggcggccccgggcacgaggagcccaucccgauggccaccuacggcuggaaccuggugaagcugcacagcgggaaggacguguucuucacgccgcccgagaagugcgacacccuccugugcgacaucggcgaguccagccccaacccgacgaucgaggaggggcggacccugcgcguccucaagaugguggagcccuggcugcggggcaaccaguucugcaucaagauccugaaccccuacaugcccuccguggucgagacccucgagcagaugcagcgcaagcacggcgggaugcuggugcggaacccgcugagccgcaacuccacccacgagauguacugggugagcugcggcacggggaacaucgucuccgccgugaacaugaccagccggaugcuccugaaccgcuucaccauggcccaccgcaagcccaccuacgagcgggacguggaccugggcgccggcacgcgccacgucgcgguggagcccgagguggccaaccucgacaucaucgggcagcggaucgagaacaucaagaacgagcacaaguccaccuggcacuacgacgaggacaaccccuacaagaccugggccuaccacggcagcuacgaggucaagccguccgggagcgccuccagcauggugaacggcgugguccgccugcugaccaagcccugggacgugauccccauggucacgcagaucgccaugaccgacaccacccccuucgggcagcagcggguguucaaggagaagguggacacgcgcaccccgcgggcgaagcgcggcaccgcccaggucauggaggugaccgccaaguggcucuggggcuuccugagccggaacaagaagccccgcaucugcacgcgggaggaguucacccgcaaggugcgguccaacgccgccaucggggcggucuucguggacgagaaccaguggaacagcgccaaggaggccguggaggacgagaaguucugggaccugguccaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacucccugagcggcguggagggggagggccuccacaagcugggguacauccugcgcgacaucuccaagauccccggcggcaacauguacgccgacgacaccgcggggugggacacgcggaucaccgaggacgaccuccagaacgaggccaagaucaccgacaucauggagccggagcacgcccugcuggccaccagcaucuucaagcucacguaccagaacaaggucgugcgcgugcagcgccccgccaagaacggcaccgucauggacgugaucucccggcgcgaccagcgggggagcggccaggugggcaccuacgggcugaacaccuucacgaacauggagguccagcugauccgccagauggaguccgagggcaucuuccuccccagcgagcuggagacccccaaccuggcggagcgggugcucgacuggcuggagaagcacgggaccgagcgccugaagcggauggccaucuccggcgacgacugcguggucaagccgaucgacgaccgcuucgccaccgcccucaucgcccugaacgacauggggaaggugcggaaggacaucccccagugggagcccagcaagggcuggaacgaguggcagcagguccccuucugcucccaccacuuccaccagcugaucaugaaggacggccgcgagaucgucgugccgugccggaaccaggacgagcucguggggcgcgcgcgggucagccagggcgccggguggucccugcgcgagacggccugccugggcaagagcuacgcccagauguggcagcucauguacuuccaccggcgcgaccugcggcuggccgcgaacgccaucugcagcgccgugcccguggacuggguccccaccucccgcaccaccuggagcauccacgcccaccaccaguggaugaccacggaggacaugcucuccguguggaaccggguguggaucgaggagaaccccuggauggaggacaagacccacgucagcuccugggaggaggugccguaccuggggaagcgcgaggaccaguggugcggcagccugaucggccucaccgcgcgcgccaccugggccacgaacauccagguggccaucaaccagguccggcgccugaucgggaacgagaacuaccuggacuacaugaccuccaugaagcgguucaagaacgagagcgaccccgagggcgcccucugguga

SEQ ID NO: 8226 - RNA, 9879 nt, Artificial Sequence
  derived and/or modified CDS sequence (opt1) from DENV-1__FJ478458__SS-prME
agcgugaccaugcugcucaugcugcugcccaccgcccucgccuuccaccugaccacccggggcggggagccccacaugaucgugagcaagcaggagcggggcaagagccuccuguucaagaccagcgccgggaucaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgggacaagcgguccgucgcccuggcgccccacgugggccuggggcucgagacgcgcaccgagaccuggaugagcuccgagggcgccuggaagcagauccagaagguggagaccugggcccugcggcaccccggguucacggugaccgcccuguuccucgcgcacgccaucggcaccagcaucacccagaaggggaucaucuucauccugcugaugcucgugacgcccuccauggccaugcgcugcgugggcaucggcaaccgggacuucguggaggggcugagcggcgccaccuggguggacgugguccuggagcacggguccugcgugaccaccauggccaaggacaagcccacgcucgacaucgagcugcugaagaccgaggugaccaaccccgcgauccuccgcaagcugugcaucgaggccaagaucagcaacaccacgaccgacucccggugccccacccagggcgaggccacccuggucgaggagcaggacagcaacuucgugugccgccggacguucguggaccgcggcugggggaacggcugcggccucuucggcaaggggucccugcugaccugcgccaaguucaagugcgucaccaagcucgagggcaagaucgugcaguacgagaaccugaaguacagcgugaucgucaccgugcacacgggcgaccagcaccagguggggaacgagaccaccgagcacggcaccaucgccaccaucacgccccaggcgcccaccuccgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccagcggggccagcaccucccaggagacguggaaccgccaggaccuccuggucaccuucaagaccgcccacgccaagaagcaggagguggugguccugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggagguggccgagacgcagcacggcaccguccugguccaggugaaguacgagggcaccgacgcgcccugcaagauccccuucagcgcccaggacgagaagggggucacccagaacggccgccucaucacggccaacccgaucgugaccgacaaggagaagcccgugaacaucgagaccgagccgcccuucggggaguccuacaucgucgugggcgccggcgagaaggcgcugaagcugagcugguucaagaagggguccagcaucggcaagauguucgaggccaccgcccgcggggcccgccggauggccauccucggcgacacggcgugggacuucggguccaucggcggcguguucaccagcgucgggaagcuggugcaccagguguucggcgccgccuacgggguccuguucuccggcgugagcuggaccaugaagaucgggaucggcauccuccugaccuggcugggccucaacucccgcagcacgucccugagcaugaccugcaucgccguggggauggucacccuguaccucggcgugauggugcaggccgacuccgggugcgucaucaacuggaagggccgcgagcugaagugcgggagcggcaucuucgugaccaacgaggugcacacguggaccgagcaguacaaguuccaggcggacagcccgaagcggcuguccgccgccaucggcaaggccugggaggagggggucugcggcauccgcagcgccacccggcucgagaacaucauguggaagcagaucuccaacgagcugaaccacauccugcucgagaacgacaugaaguucaccgugguggucggggacgcgaacggcauccuggcccaggggaagaagaugauccgcccccagcccauggagcaccgguacagcuggaaguccuggggcaaggccaagaucaucggcgccgacauccagaacaccacguucaucaucgacgggcccgacaccccggagugccccgacgaccagcgcgcguggaacaucugggagguggaggacuacggcuucgggaucuucaccaccaacaucuggcugaagcuccgggacagcuacacgcagaugugcgaccaccgccugauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacccucuggagcaacggcgugcuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccguggucguggacgagcacugcggcaaccgggggccgucccuccgcacgaccaccgugaccggcaagaucauccacgaguggugcugccggagcugcacgcugccgccccugcgcuuccgcggggaggacggcugcugguacgggauggagauccgccccgucaaggagaaggaggagaaccucgugcgguccauggugagcgccggcagcggcgaggucgacuccuucagccuggggauccugugcguguccaucaugaucgaggaggugaugcgcagccgguggucccgcaagaugcucaugaccggcacccuggccgucuuccugcuccugaucauggggcagcugaccuggaacgaccucauccgccugugcaucauggugggcgcgaacgccagcgaccggauggggaugggcacgaccuaccuggcccucauggccaccuucaagaugcgcccgauguucgccgugggccugcuguuccggcgccucaccucccgggagguccugcugcucacgaucgggcugagccugguggcguccguggagcuccccaacagccuggaggagcugggcgacgggcucgccaugggcaucaugaugcugaagcugcucaccgaguuccagccccaccagcuguggaccacccugcucucccugacguucaucaagaccacccugagccucgacuacgccuggcgcaccauggccaugguccuguccaucgcgagccuguucccccucugccuguccacgaccagccagaagaccaccuggcugccggugcuccugggcuccuucgggugcaagccccugacgauguuccucaucaccgagaacaagaucuggggccgcaagagcuggccccugaacgaggggaucauggccaucggcaucgucuccauccugcucagcagccugcugaagaacgacgugccccucgccgggccgcugaucgccggcggcaugcugaucgccugcuacgugaucuccgggagcuccgcggaccucagccuggagaaggccgccgaggucuccugggaggaggaggccgagcacagcggcaccucccacaacauccugguggaggugcaggacgacgggaccaugaagaucaaggacgaggagcgcgacgacacccucacgauccugcugaaggccacccuccuggcggucagcggcguguaccccauguccauccccgccacccuguucgugugguacuucuggcagaagaagaagcagcggagcgggguccucugggacacccccuccccgcccgagguggagcgcgccgugcuggacgacggcaucuaccggauccugcagcgcggccugcucgggcggagccaggucggcguggggguguuccaggacggcgucuuccacacgauguggcacgugacccgcggggccgugcugauguaccagggcaagcggcuggagcccuccugggccagcgucaagaaggaccucaucuccuacggcgggggcuggcgcuuccaggggagcuggaacaccggcgaggagguccaggugaucgcggucgagcccgggaagaacccgaagaacgugcagaccacgcccggcaccuucaagacccccgagggcgaggugggggccaucgcccuggacuucaagcccggcaccuccgggagcccgaucgucaaccgggagggcaagaucgugggccuguacgggaacggcguggucacgaccuccgggaccuacgugagcgccaucgcccaggcgaagaccagccaggagggcccccuccccgagaucgaggaggagguguucaagaagcgcaaccugacgaucauggaccugcacccgggguccggcaagacccggcgcuaccuccccgccaucguccgggaggccaucaagcgcaagcugcgcacccugauccucgcccccacccgggugguggcgagcgagauggccgaggcccugaagggcaugcccauccgcuaccagacgaccgccgucaaguccgagcacaccgggcgggagaucguggaccugaugugccacgccaccuucacgaugcgccuccugagcccggugcggguccccaacuacaacaugaucaucauggacgaggcgcacuucaccgaccccgccuccaucgccgcccgcggcuacaucagcacccggguggggaugggcgaggccgcggccaucuucaugaccgccacgcccccgggguccguggaggccuucccccagagcaacgccgucauccaggacgaggagcgcgacauccccgagcgguccuggaacagcggcuacgacuggaucaccgacuuccccggcaagaccgugugguucgugccguccaucaagagcgggaacgacaucgcgaacugccugcgcaagaacggcaagcgggucauccagcucucccgcaagaccuucgacacggaguaccagaagaccaagaacaacgacugggacuacguggugaccaccgacaucagcgagaugggggccaacuuccgggccgaccgcgucaucgacccccggcgcugccugaagcccgugauccugaaggacggccccgagcgggugauccucgccgggccgaugcccgucacgguggcguccgccgcccagcgccggggccgcaucggccgcaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgggagaaguccgccgccaucgacggcgaguaccgccugcgcggggaggcccgcaagaccuucgucgagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggacgaaggagggcgagcgcaagaagcugcggccccgcuggcuggacgcgcggaccuacagcgacccgcucgcccugcgcgaguucaaggaguucgccgccgggcggcgcagcgucuccggcgaccugauccucgagaucggcaagcugccccagcaccugacccuccgggcccagaacgcgcuggacaaccuggugaugcuccacaacagcgagcagggcgggaaggccuaccgccacgccauggaggagcugcccgacaccaucgagacccugaugcuccuggcccugaucgcggugcucaccggcggggucacccuguucuuccuguccgggaaggggcucggcaagaccagcaucgggcugcugugcgugauggccuccagcgcccuccuguggauggccaacguggagccccacuggaucgccgcguccaucauccuggaguucuuccucaugguccugcugaucccggagcccgaccggcagcgcacgccccaggacaaccagcucgccuacguggugaucggccugcuguucaugauccucacggucgccgccaacgagauggggcugcuggagaccaccaagaaggaccucggcaucgggcacguggccgcggagaaccagcaccacgccaccaugcuggacguggaccugcggccggccagcgccuggacgcucuacgccgucgcgaccaccgugaucacccccaugaugcgccacacgaucgagaacaccaccgccaacaucucccugaccgccaucgccaaccaggccgcgauccugaugggccucgacaagggcuggcccaucagcaagauggacaucggggugccccugcuggcccucggcugcuacucccaggucaacccgcugacgcugaccgccgccgugcucaugcugguggcgcacuacgccaucaucgggcccggccugcaggccaaggccacccgcgaggcccagaagcggaccgcggccgggaucaugaagaaccccacggucgacggcaucguggccaucgaccucgaccccguggucuacgacgccaaguucgagaagcagcugggccagaucaugcugcucauccugugcaccagccagauccugcucaugcgcaccaccugggcccugugcgaguccaucacgcuggcgaccgggccgcucaccacccugugggagggcagccccgggaaguucuggaacacgaccaucgccguguccauggccaacaucuuccggggcagcuaccuggccggcgccgggcucgcguucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggccaaggaggggcucaagcggggcgagaccaccaagcacgccgucagccgcgggaccgcgaagcugcggugguucguggagcgcaaccuggugaagcccgagggcaaggucaucgaccugggcugcgggcggggcgggugguccuacuacugcgccggccucaagaaggugacggaggugaagggguacaccaagggcggccccgggcacgaggagccgauccccauggccaccuacggcuggaaccuggucaagcuguacagcgggaaggacguguucuucacgccgcccgagaagugcgacacccuccugugcgacaucggcgaguccagcccgaaccccacgaucgaggaggggcgcacccugcgggugcucaagauggucgagcccuggcugcgcggcaaccaguucugcaucaagauccugaaccccuacaugccguccgugguggagacccucgagcagaugcagcggaagcacggcgggaugcugguccgcaacccccugagccggaacuccacccacgagauguacugggugagcugcggcacggggaacaucguguccgccgucaacaugaccagccgcaugcuccugaaccgcuucaccaugacccaccggaagcccacguacgagcgcgacguggaccugggcgccggcacccggcacguggcggucgagcccgagguggccaaccucgacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcguggugcggcugcugacgaagcccugggacgucauccccauggugacccagaucgccaugaccgacaccacgccguucgggcagcagcgcgucuucaaggagaagguggacacccggacgccccgggcgaagcggggcaccgcccagaucauggaggugacggccaaguggcucuggggcuuccugucccgcaacaagaagccccggaucugcacccgcgaggaguucacccggaagguccgcagcaacgccgccaucggggcgguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcucccgggccaucugguacauguggcugggcgcccgcuuccucgaguucgaggcccugggguucaugaacgaggaccacugguucagccgggagaacuccuucagcggcgucgagggggagggccugcacaagcucggguacauccugcgcgacaucuccaagaucccgggcggcaacauguacgccgacgacacggcggggugggacacccgcaucaccgaggacgaccugcagaacgaggccaagaucaccgacaucauggagcccgagcacgcccuccuggccacgagcaucuucaagcugaccuaccagaacaagguggugcggguccagcgccccgccaagaacggcaccgugauggacgugaucucccggcgcgaccagcgggggagcggccaggucggcaccuacgggcucaacacguucaccaacauggaggugcagcugauccgccagauggaguccgagggcaucuuccugcccagcgagcucgagaccccgaaccuggcggagcgggugcuggacuggcucgagaagcacgggaccgagcgccugaagcggauggccaucuccggcgacgacugcgucgugaagcccguggacgaccgcuucgccacggcccugaucgcccucaacgacauggggaagguccggaaggacaucccccagugggagcccagcaagggcuggaacgacuggcagcaggucccguucugcucccaccacuuccaccagcugaucaugaaggacggccgcgagaucgugguccccugccggaaccaggacgagcugguggggcgcgcgcgggugagccagggcgccggguggucccuccgcgagaccgccugccugggcaagagcuacgcccagauguggcagcugauguacuuccaccggcgcgaccuccggcuggccgcgaacgccaucugcuccgccguccccguggacugggugcccaccagccgcaccaccuggagcauccacgcccaccaccaguggaugacgaccgaggacaugcuguccgucuggaaccgcguguggaucgaggagaacccguggauggaggacaagacccacgugagcuccugggaggagguccccuaccucgggaagcgggaggaccaguggugcggcagccugaucggccugaccgcgcgcgccacgugggccaccaacauccagguggccaucaaccaggugcggcgccucaucgggaacgagaacuaccuggacuacaugaccuccaugaagcgguucaagaacgagagcgaccccgagggcgcccugugguga

SEQ ID NO: 8227 - RNA, 9879 nt, Artificial Sequence
  derived and/or modified CDS sequence (opt1) from DENV-1__FJ410190__SS-prME
agcgugaccaugcugcucaugcugcugcccaccgcccucgccuuccaccugaccacccggggcggggagccccacaugaucgucagcaagcaggagcggggcaagagccugcuguucaagaccagcguggggaucaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggaagcagauccagaaggucgagaccugggcccugcggcacccgggguucaccgugaucgcccuguuccucgcccacgcgaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaaggacaagcccacccucgacaucgagcugcugaagacggaggucaccaaccccgccgugcuccgcaagcugugcaucgaggcgaagaucagcaacaccaccacggacucccggugcccgacccagggcgaggccacccugguggaggagcaggacagcaacuucgucugccgccggaccuucguggaccgcggcugggggaacggcugcggccucuucggcaaggggucccugcugacgugcgccaaguucaagugcgugaccaagcucgagggcaagaucguccaguacgagaaccugaaguacagcgugaucgugaccguccacaccggcgaccagcaccagguggggaacgagacgaccgagcacggcaccaucgccaccaucacgccccaggcccccacguccgagauccagcugaccgacuacggggcgcucacccuggacugcagcccccggaccggccuggacuucaacgagaugguccuccugacgaugaaggagaaguccuggcuggugcacaagcagugguuccucgaccugccgcugcccuggaccagcggggccagcaccucccaggagaccuggaaccgccaggaccuccuggugacguucaagaccgcccacgccaagaagcaggaggucguggugcugggcagccaggagggcgccaugcacaccgcgcucaccggggccacggagauccagaccuccggcaccaccacgaucuucgccgggcaccugaagugccggcugaagauggacaagcucacccugaagggcaugagcuacgucaugugcaccggguccuucaagcuggagaaggagguggccgagacccagcacggcacggugcugguccaggugaaguacgagggcaccgacgcccccugcaagauccccuucagcgcgcaggacgagaagggggugacccagaacggccgccucaucaccgccaacccgaucgucacggacaaggagaagcccgugaacaucgagaccgagccgcccuucggggaguccuacaucgugaucggcgccggcgagaaggcccugaagcugagcugguucaagaagggguccagcaucggcaagauguucgaggcgaccgcccgcggggcccgccggauggccauccucggcgacaccgccugggacuucggguccaucggcggcgucuucacgagcguggggaagcuggugcaccaggucuucggcgcggccuacggggugcuguucuccggcgugagcuggaccaugaagaucgggaucggcauccuccugaccuggcugggccucaacucccgcagcaccucccugagcaugacgugcaucgccgucgggauggugacccuguaccucggcgugaugguccaggccgacuccgggugcgugaucaacuggaagggccgcgagcugaagugcgggagcggcaucuucgugaccaacgagguccacaccuggacggagcaguacaaguuccaggccgacagcccgaagcggcuguccgcggccaucggcaaggccugggaggagggggugugcggcauccgcagcgccacccggcucgagaacaucauguggaagcagaucuccaacgagcugaaccacauccugcucgagaacgacaugaaguucaccguggucgugggggacgccaacggcauccuggcgcaggggaagaagaugauccgcccccagcccauggagcaccgguacagcuggaaguccuggggcaaggccaagaucaucggcgccgacauccagaacaccaccuucaucaucgacgggcccgacacgccggagugccccgacgaccagcgcgccuggaacaucugggagguggaggacuacggcuucgggaucuucaccaccaacaucuggcugaagcuccgggacagcuacacccagaugugcgaccaccgccugauguccgcggccaucaaggacagcaaggccguccacgccgacaugggcuacuggaucgaguccgagaagaacgagacguggaagcuggcccgggcgagcuucaucgaggugaagaccugcaucuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccgucgugguggacgagcacugcggcaaccgggggccgucccuccgcaccacgaccgucaccggcaagaucauccacgaguggugcugccggagcugcacccugccgccccugcgcuuccgcggggaggacggcugcugguacgggauggagauccgccccgugaaggagaaggaggagaaccucgugcgguccauggucagcgccggcagcggcgagguggacuccuucagccuggggauccugugcguguccaucaugaucgaggaggucaugcgcagccgguggucccgcaagaugcucaugacgggcacccuggccguguuccugcuccugaucauggggcagcugaccuggaacgaccucauccgccugugcaucauggugggcgccaacgcgagcgaccggauggggaugggcaccacguaccuggcccucauggccaccuucaagaugcgcccgauguucgccgucggccugcuguuccggcgccucaccucccgggaggugcugcugcucaccaucgggcugagccugguggccuccgucgagcuccccaacagccuggaggagcugggcgacgggcucgcgaugggcaucaugaugcugaagcugcucacggaguuccagccccaccagcuguggaccacccugcucucccugaccuucaucaagacgacccugagccucgacuacgccuggcgcaccauggccauggugcuguccaucgucagccuguucccccucugccuguccaccacgagccagaagaccaccuggcugccggugcuccugggcuccuucgggugcaagccccugaccauguuccucaucacggagaacaagaucuggggccgcaagagcuggccccugaacgaggggaucauggccaucggcaucguguccauccugcucagcagccugcugaagaacgacgucccccucgcggggccgcugaucgccggcggcaugcugaucgccugcuacgugaucuccgggagcuccgccgaccucagccuggagaaggccgcggagguguccugggaggaggaggccgagcacagcggcaccucccacaacauccuggucgaggugcaggacgacgggaccaugaagaucaaggacgaggagcgcgacgacacccucaccauccugcugaaggccacgcuccuggccgugagcggcgucuaccccauguccauccccgccacccuguucgugugguacuucuggcagaagaagaagcagcggagcggggugcucugggacacccccuccccgcccgaggucgagcgcgcggugcuggacgacggcaucuaccggauccugcagcgcggccugcucgggcggagccaggugggcgucgggguguuccaggacggcguguuccacaccauguggcacgucacgcgcggggccgugcugauguaccagggcaagcggcuggagcccuccugggccagcgugaagaaggaccucaucuccuacggcgggggcuggcgcuuccaggggagcuggaacaccggcgaggagguccaggugaucgccguggagcccgggaagaacccgaagaacguccagaccacccccggcacguucaagacccccgagggcgaggugggggccaucgcgcuggacuucaagcccggcaccuccgggagcccgaucgugaaccgggaggagaagaucgucggccuguacggcaacgggguggugaccacguccggcaccuacgucagcgccaucgcccaggccaagaccagccaggaggggccccuccccgagaucgaggacgagguguucaagaagcgcaaccugaccaucauggaccugcacccgggcuccgggaagacgcggcgcuaccuccccgccaucgugcgggaggcgaucaagcgcaagcugcgcacccugauccucgcccccacccgggucguggccagcgagauggccgaggcgcugaagggcaugcccauccgcuaccagaccacggccgugaaguccgagcacaccggccgggagaucgucgaccugaugugccacgccaccuucaccaugcgccuccugagcccggugcgggugcccaacuacaacaugaucaucauggacgaggcccacuucacggaccccgccuccaucgcggcccgcggguacaucagcacccgggucggcaugggggaggccgccgccaucuucaugaccgcgacgccgcccggcuccguggaggccuucccccagagcaacgccgugauccaggacgaggagcgcgacauccccgagcgguccuggaacagcggguacgacuggaucacggacuuccccggcaagaccgucugguucgugcccuccaucaagagcggcaacgacaucgccaacugccugcgcaagaacgggaagcgggugauccagcucucccgcaagaccuucgacaccgaguaccagaagacgaagaacaacgacugggacuacgucgugaccaccgacaucagcgagaugggcgccaacuuccgggcggaccgcgugaucgacccccggcgcugccugaagcccgucauccugaaggacgggcccgagcgggugauccucgccggcccgaugcccgugaccgucgccuccgccgcgcagcgccgggggcgcaucggccgcaaccagaacaaggagggcgaccaguacguguacauggggcagccccugaacaacgacgaggaccacgcccacuggacggaggccaagaugcugcucgacaacaucaacacccccgagggcaucaucccggcccuguucgagcccgagcgggagaaguccgccgcgaucgacggggaguaccgccugcggggcgaggcccgcaagaccuucgucgagcucaugcggcgcggggaccugcccguguggcuguccuacaagguggccagcgagggcuuccaguacuccgaccggcgcuggugcuucgacggcgagcggaacaaccagguccucgaggagaacauggacguggagaucuggaccaaggagggggagcgcaagaagcugcggccccgcuggcuggacgcccggacguacagcgacccgcucgcccugcgcgaguucaaggaguucgcggccggccggcgcagcguguccggggaccugauccucgagaucggcaagcugccccagcaccugacccuccgggcccagaacgcccuggacaaccuggucaugcuccacaacagcgagcagggcgggaaggccuaccgccacgcgauggaggagcugcccgacaccaucgagacccugaugcuccuggcccugaucgccgugcucaccggcggggugacgcuguucuuccuguccggcaaggggcucggcaagaccagcaucggccugcugugcgucauggccuccagcgcgcuccuguggauggccaacguggagccccacuggaucgccgccuccaucauccuggaguucuuccucauggugcugcugaucccggagcccgaccggcagcgcacgccccaggacaaccagcucgccuacgucgugaucgggcugcuguucaugauccucaccguggcggccaacgagaugggccugcuggagacgaccaagaaggaccucgggaucggccacgucgccgccgagaaccagcagcacgccaccaugcuggacguggaccugcggccggcgagcgccuggacccucuacgccguggccacgaccgucaucacccccaugaugcgccacaccaucgagaacacgaccgccaacaucucccugaccgcgaucgccaaccaggccgccauccugauggggcucgacaagggcuggcccaucagcaagauggacaucggcgugccccugcuggcccucgggugcuacucccaggugaacccgcugacccugacggcggccguccucaugcugguggcccacuacgccaucaucggccccgggcugcaggcgaaggccacccgcgaggcccagaagcggaccgccgccggcaucaugaagaaccccaccguggacgggaucgucgcgaucgaccucgaccccgugguguacgacgccaaguucgagaagcagcugggccagaucaugcugcucauccugugcacgagccagauccugcucaugcgcaccaccugggcccugugcgaguccaucacccuggccacgggcccgcucaccacccugugggaggggagccccggcaaguucuggaacaccacgaucgccgucuccauggcgaacaucuuccgggggagcuaccuggccggcgccggccucgccuucucccugaugaagucccucgggggcgggcgccgggggaccggggcccagggcgagacccucggcgagaaguggaagcgccagcugaaccagcuguccaagagcgaguucaacaccuacaagcggagcgggaucauggagguggaccgcuccgaggcgaaggagggccucaagcgcggggagacgaccaagcacgccgugagccgcggcaccgccaagcugcggugguucgucgagcgcaaccuggugaagcccgaggggaaggugaucgaccugggcugcggccgcggcgggugguccuacuacugcgccgggcucaagaaggucaccgaggugaagggguacacgaagggcgggcccggccacgaggagccgauccccauggcgaccuacggguggaaccuggugaagcuguacagcggcaaggacgucuucuucacgccgcccgagaagugcgacacccuccugugcgacaucggggaguccagcccgaaccccaccaucgaggagggccgcacgcugcgggugcucaagaugguggagcccuggcugcgcgggaaccaguucugcaucaagauccugaaccccuacaugccguccgucguggagacccucgagcagaugcagcggaagcacggcggcaugcuggugcgcaacccccugagccggaacuccacccacgagauguacugggucagcugcgggaccggcaacaucguguccgccgugaacaugacgagccgcaugcuccugaaccgcuucaccauggcccaccggaagcccaccuacgagcgcgacgucgaccugggggccggcacccggcacguggccguggagcccgaggucgcgaaccucgacaucaucggccagcgcaucgagaacaucaagaacgagcacaaguccacguggcacuacgacgaggacaacccguacaagaccugggccuaccacgggagcuacgaggugaagcccuccggcagcgccuccagcauggugaacggggucgugcggcugcugaccaagcccugggacgucauccccauggugacccagaucgccaugacggacaccaccccguucggccagcagcgcguguucaaggagaaggucgacacccggacgccccgcgccaagcgggggaccgcgcagaucauggaggugaccgccaaguggcucuggggcuuccugucccgcaacaagaagccccggaucugcacccgcgaggaguucacgcggaaggugcgcagcaacgccgccaucggcgccgucuucguggacgagaaccaguggaacagcgcgaaggaggccguggaggacgagcgguucugggaccugguccaccgcgagcgggagcuccacaagcaggggaagugcgcgaccugcguguacaacaugaugggcaagcgcgagaagaagcugggggaguucggcaaggccaaggggucccgggcgaucugguacauguggcugggcgcccgcuuccucgaguucgaggcccugggcuucaugaacgaggaccacugguucagccgggagaacuccuucagcgggguggagggcgaggggcugcacaagcucggcuacauccugcgcgacaucuccaagauccccgggggcaacauguacgccgacgacaccgccggcugggacacccgcaucacggaggacgaccugcagaacgaggcgaagaucaccgacaucauggagcccgagcacgcccuccuggccaccagcaucuucaagcugaccuaccagaacaaggucgugcgggugcagcgccccgccaagaacgggacggucauggacgugaucucccggcgcgaccagcggggcagcggccagguggggaccuacggccucaacaccuucaccaacauggagguccagcugauccgccagauggaguccgaggggaucuuccugcccagcgagcucgagacgccgaaccuggccgagcgggugcuggacuggcucgagaagcacggcaccgagcgccugaagcggauggcgaucuccggggacgacugcguggucaagcccguggacgaccgcuucgccaccgcccugaucgcccucaacgacaugggcaaggugcggaaggacaucccccagugggagcccagcaagggguggaacgacuggcagcaggucccguucugcucccaccacuuccaccagcugaucaugaaggacggccgcgagaucguggugcccugccggaaccaggacgagcuggucggccgcgcccgggugagccagggggcgggcuggucccuccgcgagaccgccugccugggcaagagcuacgcccagauguggcagcugauguacuuccaccggcgcgaccuccggcuggccgccaacgcgaucugcuccgccgugcccgucgacugggugcccacgagccgcaccaccuggagcauccacgcccaccaccaguggaugaccaccgaggacaugcuguccguguggaaccgcgucuggaucgaggagaacccguggauggaggacaagacgcacgugagcuccugggaggaggugcccuaccucggcaagcgggaggaccaguggugcgggagccugaucggccugaccgcccgcgcgaccugggccaccaacauccaggucgccaucaaccaggugcggcgccucaucggcaacgagaacuaccuggacuacaugacguccaugaagcgguucaagaacgagagcgaccccgagggggcccugugguga

SEQ ID NO: 8228 - RNA, 9879 nt, Artificial Sequence
  derived and/or modified CDS sequence (opt1) from DENV-1__EU482591__SS-prME
agcgugaccaugcugcucaugcugcugcccaccgcccucgccuuccaccugaccacccgcggcggggagccccacaugaucgucagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggcccucagcaucgugucccuguucccccugugccucagcaccacgucccagaagaccaccuggcugccgguccugcucgggagcuucggcugcaagccccugaccauguuccugaucaccgagaacaagaucugggggcggaaguccuggccccucaacgagggcaucauggcgaucgggaucgugagcauccugcuguccagccuccugaagaacgacgugccccuggccggcccgcucaucgccggcgggaugcugaucgccugcuacgucaucagcggcuccagcgccgaccugucccucgagaaggcggccgaggugagcugggagcaggaggccgagcacuccggggccagccacuccauccugguggagguccaggacgacggcacgaugaagaucaaggacgaggagcgcgacgacacccugaccauccuccugaaggccacccugcucgcggugagcgggguguaccccauguccauccccgccacgcuguucgucugguacuucuggcagaagaagaagcagcggagcggcgugcugugggacacccccuccccgcccgagguggagcgcgccguccucgacaacggcaucuaccggauccugcagcgcgggcugcugggccggagccaggugggggugggcgucuuccaggacgggguguuccacaccauguggcacgugacccgcggcgccguccucauguaccagggcaagcggcuggagcccuccugggccagcgugaagaaggaccugaucuccuacgggggcggguggcgcuuccagggcagcuggaacacgggggaggaggugcaggucaucgcgguggagcccggcaagaacccgaagaacgugcagaccacccccggcaccuucaagacgcccgagggggaggucggcgccaucgcccucgacuucaagcccgggaccuccggcagcccgaucgugaaccgggagggcaagaucguggggcuguacggcaacggggucgugaccaccuccggcacguacgugagcgccaucgcccaggcgaaggccagccaggaggggccccugcccgagaucgaggacgaggucuucaagaagcgcaaccucaccaucauggaccugcacccgggcuccggcaagacccggcgcuaccugcccgccaucgugcgggaggccaucaagcgcaagcuccgcacccugauccuggcgcccacgcggguggucgccagcgagauggccgaggcccucaaggggaugcccauccgcuaccagaccaccgccgugaaguccgagcacaccggccgggagaucguggaccugaugugccacgcgacguucaccaugcgccugcucagcccgguccgggugcccaacuacaacaugaucaucauggacgaggcccacuucaccgaccccgccuccaucgccgcccgcggguacaucagcacccgggugggcaugggggaggcggccgccaucuucaugacggccacgccgcccggcuccgucgaggccuucccccagagcaacgcggugauccaggacgaggagcgcgacauccccgagcgguccuggaacagcggcuacgacuggaucaccgacuuccccgggaagaccgugugguucguccccuccaucaagagcggcaacgacaucgccaacugccugcgcaagaacgggaagcgggugauccagcugucccgcaagacguucgacaccgaguaccagaagaccaagaacaacgacugggacuacguggucaccacggacaucagcgagaugggcgccaacuuccgggccgaccgcgugaucgacccccggcgcugccucaagcccgugauccugaaggacgggcccgagcgggucauccuggcgggcccgaugcccgugaccgucgccuccgccgcccagcgccggggccgcaucgggcgcaaccagaacaaggagggcgaccaguacguguacauggggcagccccucaacaacgacgaggaccacgcccacuggaccgaggcgaagaugcugcuggacaacaucaacacccccgagggcaucaucccggcccucuucgagcccgagcgggagaaguccgccgccaucgacggggaguaccgccugcggggcgaggcccgcaagacguucguggagcugaugcggcgcggcgaccuccccgucuggcuguccuacaagguggcgagcgagggguuccaguacuccgaccggcgcuggugcuucgacggcgagcggaacaaccaggugcuggaggagaacauggacgucgagaucuggaccaaggagggggagcgcaagaagcuccggccccgcuggcuggacgcccggaccuacagcgacccgcuggcccuccgcgaguucaaggaguucgccgccggccggcgcagcguguccggcgaccugauccuggagaucgggaagcucccccagcaccugacccugcgggcgcagaacgcccucgacaaccuggugaugcugcacaacagcgagcagggcgggaaggccuaccgccacgccauggaggagcuccccgacaccaucgagacgcugaugcugcucgcgcugaucgccguccugaccggcggggugacccucuucuuccuguccggcaagggccuggggaagaccagcaucggccuccugugcgugacggccuccagcgcccugcucuggauggccuccgucgagccccacuggaucgcggccagcaucauccuggaguucuuccugauggugcuccugaucccggagcccgaccggcagcgcacgccccaggacaaccagcuggccuacguggucaucgggcuccuguucaugauccugaccguggccgccaacgagaugggccuccuggagaccacgaagaaggaccuggggaucggcuacguggcggccgagaaccaccagcacgccaccaugcucgacgucgaccugcacccggccuccgccuggacccuguacgcgguggccaccacggugaucacccccaugaugcggcacaccaucgagaacaccacggccaacaucagccucaccgccaucgccaaccaggcggccauccugaugggccuggacaagggguggcccaucuccaagauggacaucggcgucccccuccuggcccuggggugcuacagccaggugaacccgcucacccugaccgccgcggugcugaugcucgucgcccacuacgccaucaucggccccgggcugcaggccaaggccacgcgcgaggcgcagaagcgcaccgccgccggcaucaugaagaaccccaccguggacggcaucguggccaucgaccuggaccccgucguguacgacgccaaguucgagaagcagcucgggcagaucaugcugcugauccucugcaccucccagauccugcugaugcggacgaccugggcgcucugcgagagcaucacccuggccaccggcccgcugacgacccucugggaggggucccccggcaaguucuggaacaccaccaucgccgugagcauggccaacaucuuccgcggcuccuaccuggccggggcgggccuggccuucagccucaugaagucccucgggggcgggcggcgcggcacgggcgcccagggggagacccugggcgagaaguggaagcggcagcucaaccagcugagcaagagcgaguucaacaccuacaagcgcuccgggaucauggaggucgaccggagcgaggccaaggagggccugaagcgcggggagaccacgaagcacgcggugucccggggcaccgccaagcuccgcugguucguggagcggaaccuggucaagcccgagggcaaggugaucgaccuggggugcggccgcgggggcuggagcuacuacugcgccgggcugaagaaggugaccgaggucaagggcuacaccaagggcgggcccggccacgaggagccgauccccauggccaccuacggguggaaccucgugaagcugcacuccggcaaggacguguucuucaugccgcccgagaagugcgacacgcugcucugcgacaucggggagagcuccccgaaccccaccaucgaggagggccggacccugcgcguccugaagaugguggagcccuggcuccggggcaaccaguucugcaucaagauccugaaccccuacaugccgagcguggucgagacccuggagcgcaugcagcggaagcacgggggcaugcucgugcgcaacccccugucccggaacagcacgcacgagauguacuggguguccugcgggaccggcaacaucgucagcgccgugaacaugaccucccgcaugcugcucaaccgcuucaccauggcgcaccggaagcccacguacgagcgcgacguggaccugggcgccgggacccggcacgucgccguggagcccgagguggccaaccuggacaucaucggccagcgcaucgagaacaucaagaacgagcacaagagcaccuggcacuacgacgaggacaacccguacaagaccugggccuaccacggguccuacgaggucaagcccagcggcuccgcgagcuccauggugaacggggucgugcggcuccugacgaagcccugggacgugauccccauggucacccagaucgccaugaccgacaccacgccguucggccagcagcgcguguucaaggagaagguggacacccggacgccccgcgccaagcggggcaccacgcagaucauggaggucaccgccaaguggcuguggggguuccucagccgcaacaagaagccccggaucugcacccgcgaggaguucacccggaaggugcgcagcaacgccgcgaucggcgccguguucgucgacgagaaccaguggaacuccgccaaggaggccguggaggacgagcgguucugggaccuggugcaccgcgagcgggagcugcacaagcaggggaagugcgcgacgugcgucuacaacaugaugggcaagcgcgagaagaagcucggggaguucggcaaggccaagggcagccgggccaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgcggacgacaccgccggcugggacacccgcaucaccgaggacgaccugcagaacgaggccaagaucacggacaucauggagcccgagcacgcccuccuggccaccuccaucuucaagcugaccuaccagaacaaggugguccgggugcagcgccccgcgaagaacgggaccgugauggacgucaucagccggcgcgaccagcggggcuccggccagguggggacguacggccucaacaccuucaccaacauggaggugcagcugauccgccagauggagagcgaggggaucuuccugcccuccgagcucgagaccccgaaccuggccgagcgggcccuggacuggcucgagaagcacggcgccgagcgccugaagcggauggccaucagcggggacgacugcgucgugaagcccaucgacgaccgcuucgcgacggcccugaccgcccucaacgacaugggcaaggugcggaaggacaucccccagugggagcccuccaagggcuggaacgacuggcagcaggucccguucugcagccaccacuuccaccagcugaucaugaaggacgggcgcgagaucguggugcccugccggaaccaggacgagcuggucggccgcgcccgggugucccagggggccggcuggagccuccgcgagaccgcgugccuggggaaguccuacgcccagauguggcagcugauguacuuccaccggcgcgaccuccggcuggccgccaacgcgaucugcagcgccgugcccgucgacugggugcccaccagccgcaccacgugguccauccacgcccaccaccaguggaugaccaccgaggacaugcugagcguguggaaccgcgucuggaucgaggagaacccguggauggaggacaagacccacguguccagcugggaggaggugcccuaccucggcaagcgggaggaccaguggugcggcucccugaucgggcugacggcccgcgccaccugggcgaccaacauccaggucgccaucaaccaggugcggcgccucaucggcaacgagaacuaccuggacuacaugaccagcaugaagcgguucaagaacgaguccgacagcgagggggcccugugguga

SEQ ID NO: 8229 - RNA, 9879 nt, Artificial Sequence
  derived and/or modified CDS sequence (opt1) from DENV-1__EU482592__SS-prME
agcgugaccaugcugcucaugcugcugcccaccgcccucgccuuccaccugaccacccggggcggggagccccacaugaucguguccaagcaggagcggggcaagagccuccuguucaagaccuccgccgggaucaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagauccagaagguggagaccugggcccugcggcaccccggguucacggucaccgcccuguuccucgcgcacgccaucggcaccagcaucacccagaaggggaucaucuucauccugcugaugcucgugacgcccuccauggccaugcgcugcgugggcaucggcaaccgggacuucgucgaggggcugagcggcgccaccuggguggacgugguccuggagcacggguccugcgugaccaccauggccaaggacaagcccacgcucgacaucgagcugcugaagaccgaggugaccaaccccgcgguccuccgcaagcugugcaucgaggccaagaucagcaacaccacgaccgacucccggugcccgacccagggcgaggccacccugguggaggagcaggacagcaacuucgugugccgccggacguucgucgaccgcggcugggggaacggcugcggccucuucggcaaggggucccugcugaccugcgccaaguucaagugcgugaccaagcucgagggcaagaucgugcaguacgagaaccugaaguacagcgucaucgugaccgugcacacgggcgaccagcaccaggucgggaacgagaccaccgagcacggcaccaucgccaccaucacgccccaggcgcccaccuccgagauccagcugaccgacuacggggcccucacccuggacugcagcccccggacgggccuggacuucaacgagauggugcuccugaccaugaaggagaaguccuggcugguccacaagcagugguuccucgaccugccgcugcccuggaccagcggggccagcaccucccaggagacguggaaccgccaggaccuccuggugaccuucaagaccgcccacgccaagaagcaggagguggucgugcugggcagccaggagggcgcgaugcacaccgcccucacgggggccaccgagauccagaccuccggcaccacgaccaucuucgccgggcaccugaagugccggcugaagauggacaagcucacccugaagggcaugagcuacgugaugugcaccggguccuucaagcuggagaaggaggucgccgagacgcagcacggcaccgugcuggugcaggucaaguacgagggcaccgacgcgcccugcaagauccccuucagcgcccaggacgagaagggggugacccagaacggccgccucaucacggccaacccgaucgugaccgacaaggagaagcccgucaacaucgagaccgagccgcccuucggggaguccuacaucguggugggcgccggcgagaaggcgcugaagcugagcugguucaagaagggguccagcaucggcaagauguucgaggccaccgcccgcggggcccgccggauggccauccucggcgacacggcgugggacuucggguccaucggcggcgucuucaccagcguggggaagcuggugcaccaggucuucggcgccgccuacggggugcuguucuccggcgugagcuggaccaugaagaucgggaucggcauccuccugaccuggcugggccucaacucccgcagcacgucccugagcaugaccugcaucgccgucgggauggugacccuguaccucggcgugaugguccaggccgacuccgggugcgugaucaacuggaagggccgcgagcugaagugcgggagcggcaucuucgugaccaacgagguccacacguggaccgagcaguacaaguuccaggcggacagcccgaagcggcuguccgccgccaucggcaaggccugggaggagggggugugcggcauccgcagcgccacccggcucgagaacaucauguggaagcagaucuccaacgagcugaaccacauccugcucgagaacgacaugaaguucaccguggucgugggggacgcgaacggcauccuggcccaggggaagaagaugauccgcccccagcccauggagcaccgguacagcuggaaguccuggggcaaggccaagaucaucggcgccgacauccagaacagcaccuucaucaucgacgggcccgacacgccggagugccccgacgaccagcgcgcguggaacaucugggagguggaggacuacggcuucgggaucuucaccaccaacaucuggcugaagcuccgggacuccuacacccagaugugcgaccaccgccugaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccucugguccaacggcgugcuggagagcgagaugaucauccccaagaucuacgggggcccgaucucccagcacaacuaccgccccggguacuucacccagacggccggccccuggcaccuggggaagcucgagcuggacuucgaccugugcgagggcaccaccgucgugguggacgagcacugcggcaaccgggggccgagccuccgcaccacgaccgucaccggcaagaucauccacgaguggugcugccgguccugcacccugccgccccugcgcuuccgcggggaggacggcugcugguacgggauggagauccgccccgugaaggagaaggaggagaaccucgugcggagcauggucagcgccggcuccggcgagguggacagcuucucccuggggauccugugcgugagcaucaugaucgaggaggucaugcgcucccgguggagccgcaagaugcucaugacgggcacccuggccguguuccugcuccugaucauggggcagcugaccuggaacgaccucauccgccugugcaucauggugggcgcgaacgccuccgaccggauggggaugggcaccacguaccuggcccucauggccaccuucaagaugcgcccgauguucgccgucgggcugcuguuccggcgccucaccagccgggaggugcugcugcucaccaucgggcugucccugguggcgagcgucgagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgccuggcgcaccauggccauggugcugagcaucgucucccuguucccccucugccugagcaccacgucccagaagaccaccuggcugccggugcuccugggcagcuucgggugcaagccccugaccauguuccucaucacggagaacaagaucuggggccggaaguccuggccccugaacgaggggaucauggcgaucggcaucgugagcauccugcucagcucccugcugaagaacgacgucccccucgccgggccgcugaucgccggcggcaugcugaucgccugcuacgugaucagcggguccagcgccgaccucucccuggagaaggcggccgaggugagcugggaggaggaggccgagcacuccggcaccagccacaacauccuggucgaggugcaggacgacgggaccaugaagaucaaggacgaggagcgcgacgacacccucaccauccugcugaaggccacgcuccuggccguguccggcgucuaccccaugagcauccccgcgacccuguucgugugguacuucuggcagaagaagaagcagcgguccggggugcucugggacacccccagcccgcccgaggucgagcgcgccgugcuggacgacggcaucuaccggauccugcagcgcggccugcucgggcggucccaggugggcgucgggguguuccaggacggcguguuccacaccauguggcacgucacgcgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagaccacccccggcacguucaagacccccgagggcgaggugggggcgaucgcccuggacuucaagcccggcaccagcggguccccgaucgugaaccgggagggcaagaucgucggccuguacgggaacggcguggugaccacgagcgggaccuacgucagcgccaucgcccaggccaagaccucccaggagggcccccuccccgagaucgaggaggagguguucaagaagcgcaaccugaccaucauggaccugcacccggggagcggcaagacgcggcgcuaccuccccgcgaucgugcgggaggccaucaagcgcaagcugcgcacccugauccucgcccccacccgggucguggccuccgagauggcggaggcccugaagggcaugcccauccgcuaccagaccacggccgucaagagcgagcacaccgggcgggagaucgucgaccugaugugccacgccaccuucaccaugcgccuccuguccccggugcgggugcccaacuacaacaugaucaucauggacgaggcccacuucacggaccccgcgagcaucgccgcccgcggcuacaucuccacccgggucgggaugggcgaggccgccgcgaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccugcgcaagaacggcaagcgggugauccagcucagccgcaagaccuucgacaccgaguaccagaagacgcggaacaacgacugggacuacgucgugaccaccgacaucuccgagaugggggcgaacuuccgcgccgaccgggugaucgacccccgccggugccugaagcccgucauccugaaggacggccccgagcgcgugauccucgccgggccgaugcccgugaccgucgccagcgcggcccagcggcgcggccgcaucggccggaaccagaacaaggagggggaccaguacguguacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccggcugcgcggggaggcccggaagaccuucgucgagcucaugcgccggggcgaccugcccguguggcugagcuacaagguggccuccgagggcuuccaguacagcgaccgccgguggugcuucgacggggagcgcaacaaccagguccucgaggagaacauggacguggagaucuggaccaaggagggcgagcggaagaagcugcgcccccgguggcuggacgcccgcacguacagcgacccgcucgcgcugcgggaguucaaggaguucgccgccgggcgccgguccgugagcggcgaccugauccucgagaucggcaagcugccccagcaccugacccuccgcgcccagaacgcccuggacaaccuggucaugcuccacaacuccgagcagggcgggaaggcguaccggcacgccauggaggagcugcccgacaccaucgagacccugaugcuccuggcccugaucgccgugcucaccgggggcgugacgcuguucuuccugagcgggaagggccucggcaagaccuccaucgggcugcugugcgucauggcgagcuccgcccuccuguggauggccaacguggagccccacuggaucgccgccagcaucauccuggaguucuuccucauggugcugcugaucccggagcccgaccgccagcggacgccccaggacaaccagcucgcguacgucgugaucggccugcuguucaugauccucaccguggccgccaacgagauggggcugcuggagacgaccaagaaggaccucggcaucggguacgucgccgccgagaaccagcaccacgcgaccaugcuggacguggaccugcgcccggccuccgccuggacccucuacgccguggccacgaccgucaucacccccaugaugcgccacaccaucgagaacacgaccgcgaacaucagccugaccgccaucgccaaccaggccgccauccugaugggccucgacaagggcuggcccaucuccaagauggacaucggggugccccugcuggcgcucggcugcuacagccaggugaacccgcugacccugacggccgccguccucaugcugguggcccacuacgcgaucaucgggcccggccugcaggccaaggccacccgggaggcccagaagcgcaccgccgcggggaucaugaagaaccccaccguggacggcaucgucgccaucgaccucgaccccgugguguacgacgccaaguucgagaagcagcugggccagaucaugcugcucauccugugcacgucccagauccugcucaugcggaccaccugggcccugugcgagagcaucacccuggccacggggccgcucaccacccugugggagggcucccccgggaaguucuggaacaccacgaucgcggucagcauggccaacaucuuccgcggcuccuaccuggccggcgccgggcucgccuucagccugaugaagucccugggcgggggccggcgcgggaccggcgcgcagggcgagacccucggggagaaguggaagcggcagcugaaccagcugagcaagagcgaguucaacaccuacaagcgcuccggcaucauggagguggaccggagcgaggccaaggaggggcucaagcgcggcgagacgaccaagcacgccgugucccgggggaccgccaagcugcgcugguucgucgagcggaaccuggugaagcccgagggcaaggugaucgaccugggcugcgggcgcggcggguggagcuacuacugcgcgggccucaagaaggucaccgaggugaagggguacacgaagggcggccccgggcacgaggagccgauccccauggccaccuacggcuggaaccuggugaagcuguacuccgggaaggacgucuucuucacgccgcccgagaagugcgacacccuccugugcgacaucggcgagagcuccccgaaccccaccaucgaggaggggcggacgcugcgcgugcucaagaugguggagcccuggcugcggggcaaccaguucugcaucaagauccugaaccccuacaugccgagcgucguggagacccucgagcagaugcagcgcaagcacggcgggaugcuggugcggaacccccugucccgcaacagcacccacgagauguacugggucuccugcggcaccgggaacaucgugagcgccgugaacaugacgucccgcaugcuccugaaccgguucaccaugacccaccgcaagcccaccuacgagcgggacgucgaccugggcgccggcacgcgccacguggccguggagcccgaggucgcgaaccucgacaucaucgggcagcggaucgagaacaucaagaacgagcacaagagcaccugguacuacgacgaggacaacccguacaagaccugggccuaccacggcuccuacgaggugaagcccagcggguccgccagcuccauggugaacggcgucgugcgccugcugaccaagcccugggacgucauccccauggugacgcagaucgccaugaccgacaccaccccguucgggcagcagcggguguucaaggagaaggucgacacgcgcacgccccgggccaagcgcggcaccgcgcagaucauggaggugaccgccaaguggcucuggggcuuccugagccggaacaagaagccccgcaucugcacgcgggaggaguucacccgcaaggugcggagcaacgccgccaucggggccgucuucguggacgagaaccaguggaacuccgcgaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgcgaucugguacauguggcugggcgcccgguuccucgaguucgaggcccugggguucaugaacgaggaccacugguucucccgcgagaacagcuucuccggcguggagggggagggccugcacaagcucggguacauccugcgcgacaucagcaagaucccgggcggcaacauguacgccgacgacaccgccgggugggacacgcggaucaccgaggacgaccugcagaacgaggcgaagaucaccgacaucauggagcccgagcacgcccuccuggccaccuccaucuucaagcugacguaccagaacaaggucgugcgcgugcagcggcccgccaagaacggcaccgucauggacgugaucagccgccgggaccagcgcggguccggccaggugggcaccuacgggcucaacaccuucacgaacauggagguccagcugauccggcagauggagagcgagggcaucuuccugcccuccgagcucgagaccccgaaccuggccgagcgcgugcugaacuggcucgagaagcacgggaccgagcggcugaagcgcauggcgaucagcggcgacgacugcguggucaagcccguggacgaccgguucgccaccgcccugaucgcccucaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcuggucgggcgggcccgcgugucccagggcgcgggguggagccuccgggagacggccugccugggcaaguccuacgcccagauguggcagcugauguacuuccaccgccgggaccuccgccuggccgccaacgcgaucugcagcgccgugcccgucgacugggugcccaccagccgcaccaccugguccauccacgcccaccaccaguggaugaccacggaggacaugcugagcguguggaaccgggucuggaucgaggagaacccguggauggaggacaagacccacguguccagcugggaggaggugcccuaccucgggaagcgcgaggaccaguggugcggcucccugaucggccugaccgcccgggcgaccugggccacgaacauccaggucgccaucaaccaggugcgccggcucaucgggaacgagaacuaccuggacuacaugaccagcaugaagcgcuucaagaacgaguccgaccccgagggcgcccugugguga

SEQ ID NO: 8230 - RNA, 9879 nt, Artificial Sequence
  derived and/or modified CDS sequence (opt1) from DENV-1__EU482609__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucggccugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggcccgggcgagccaggaggggccccuccccgagaucgaggacgaggucuucaagaagcgcaaccugaccaucauggaccugcacccgggcagcggcaagacccggcgcuaccuccccgccaucgugcgggaggccaucaagcgcaagcugcgcacccugauccucgcccccacgcggguggucgcguccgagauggccgaggcccugaaggggaugcccauccgcuaccagaccaccgccgucaagagcgagcacaccggccgggagaucguggaccugaugugccacgccacguucaccaugcgccuccuguccccgguccgggugcccaacuacaacaugaucaucauggacgaggcgcacuucaccgaccccgccagcaucgccgcccgcggguacaucuccacccgggugggcaugggggaggccgcggccaucuucaugacggccacgccgcccggcagcgucgaggccuucccccaguccaacgccgugauccaggacgaggagcgcgacauccccgagcggagcuggaacuccggcuacgacuggaucaccgacuuccccgggaagaccgugugguucguccccagcaucaaguccggcaacgacaucgcgaacugccugcgcaagaacgggaagcgggugauccagcucagccgcaagacguucgacaccgaguaccagaagaccaagaacaacgacugggacuacguggucaccacggacaucuccgagaugggcgccaacuuccgggccgaccgcgugaucgacccccggcgcugccugaagcccgugauccugaaggacgggcccgagcgggucauccucgccggcccgaugcccgugaccgucgcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucguggagcucaugcggcgcggcgaccugcccgucuggcugagcuacaagguggccuccgagggguuccaguacagcgaccggcgcuggugcuucgacggcgagcggaacaaccaggugcucgaggagaacauggacgucgagaucuggaccaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcggccggccagcgccuggacccucuacgccguggcgaccacggugaucacccccaugaugcgccacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcggaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcgcacgaccugggcccugugcgaguccaucacccuggcgaccggcccgcucacgacccugugggaggggagccccggcaaguucuggaacaccaccaucgccguguccauggccaacaucuuccggggcagcuaccuggccggggccggccucgcguucucccugaugaagucccucgggggcgggcgccgggggacgggcgcccagggggagacccucggcgagaaguggaagcgccagcugaaccagcuguccaagagcgaguucaacaccuacaagcggagcgggaucauggaggucgaccgcuccgaggccaaggagggccucaagcgcggggagaccacgaagcacgccgugagccgcggcaccgcgaagcugcggugguucguggagcgcaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccgcacccugcggguccucaagaugguggagcccuggcugaagggcaaccaguucugcaucaagauccugaaccccuacaugccguccguggucgagacccucgagcagaugcagcgcaagcacgggggcaugcuggugcggaacccccugagccgcaacuccacgcacgagauguacugggugagcugcgggaccggcaacaucgucuccgccgugaacaugaccagccggaugcuccugaaccgcuucaccauggcccaccgcaagcccacguacgagcgggacguggaccugggcgcggggacccgccacgucgccguggagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgcccgguggcucuggggguuccugucccgcaacaagaagccccggaucugcacccgcgaggaguucacccggaaggugcgcagcaacgccgccaucggcgcgguguucgucgacgagaaccaguggaacagcgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggugguccgggugcagcgccccgccaagaacgggaccgugauggacgucaucucccggcgcgaccagcggggcagcggccagguggggacguacggccugaacaccuucaccaacauggaggugcagcugauccgccagauggaguccgaggggaucuucagccccuccgagcucgagaccccgaaccuggcggagcggguccuggacuggcucgagaagcacggcgccgagcgccugaagcggauggccaucagcggggacgacugcguggugaagcccaucgacgaccgcuucgccacggcccugaccgcgcucaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcuggugggccgcgcccgggugucccagggggccggcuggagccuccgcgagaccgccugccuggggaaguccuacgcccagauguggcagcugauguacuuccaccggcgcgaccuccggcuggcggccaacgccaucugcagcgccguccccguggacugggugcccaccagccgcaccacgugguccauccacgcgcaccaccaguggaugaccaccgaggacaugcugagcgucuggaaccgcguguggaucgaggagaacccguggauggaggacaagacccacguguccagcugggaggagguccccuaccucggcaagcgggaggaccaguggugcggcucccugaucgggcugacggcccgcgccaccugggccaccaacauccagguggccaucaaccaggugcggcgccucaucggcaacgagaacuaccuggacuacaugaccagcaugaagcgguucaagaacgaguccgaccccgagggggcgcugugguga

SEQ ID NO: 8231 - RNA, 9879 nt, Artificial Sequence
  derived and/or modified CDS sequence (opt1) from DENV-1__EU482610__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcggguggagaccugggugcugcgccaccccggguucacggugaucgccuucuuccuggcccacgcgaucggcaccagcaucacccagaaggggaucaucuucauccuccugaugcuggucacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcccgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaagcucaccgugguggucggggacgccaacggcauccuggcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcuccgcgacuccuacacccagaugugcgaccaccggcugaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccucugguccaacggggugcuggagagcgagaugaucauccccaagaucuacggcgggccgaucucccagcacaacuaccggcccggcuacuucacccagaccgcggggcccuggcaccugggcaagcucgagcuggacuucgaccugugcgagggcacgaccgucgugguggacgagcacugcgggaaccgcggcccgagccuccggaccaccacggucaccgggaagaucauccacgaguggugcugccgcuccugcacccugccgccccugcgguuccgcggcgaggacgggugcugguacggcauggagauccggcccgugaaggagaaggaggagaaccucgugcgcagcauggucuccgccggcagcggggagguggacagcuucucccugggcauccugugcgugagcaucaugaucgaggaggucaugcggucccgcuggagccgcaagaugcucaugaccgggacgcuggccguguuccugcuccugaucaugggccagcugaccuggaacgaccucauccggcugugcaucauggugggggccaacgccuccgaccgcaugggcaugggcaccaccuaccuggcgcucauggccacguucaagaugcggccgauguucgccgucgggcugcuguuccgccggcucaccagccgcgaggugcugcugcucaccaucggccugucccuggucgccagcguggagcuccccaacucccuggaggagcugggggacggccucgccaugggcaucaugaugcugaagcugcucaccgaguuccagccccaccagcuguggacgacccugcucagccugaccuucgugaagaccacgcugucccucgacuacgcguggaagaccaccgccaugguccugagcaucgugucccuguucccccucugccugagcaccacgucccagaagaccaccuggcugccggugcuccuggggagcuucggcugcaagccccugaccauguuccucaucaccgagaacaagaucugggggcggaaguccuggccccugaacgagggcaucauggccaucgggaucgucagcauccugcucuccagccugcugaagaacgacgugccccucgccggcccgcugaucgcgggcgggaugcugaucgccugcuacgugaucagcggcuccagcgccgaccucucccuggagaaggccgccgaggucagcugggagcaggaggcggagcacuccggggccagccacaacauccugguggaggugcaggacgacggcacgaugaagaucaaggacgaggagcgcgacgacacccucaccauccugcugaaggccacccuccuggccgucuccgggguguaccccaugagcauccccgccacgcuguucgugugguacuucuggcagaagaagaagcagcgguccggcguccucugggacacccccagcccgcccgagguggagcgcgcggugcuggacgacggcaucuaccggauccugcagcgcgggcugcucggccggucccaggucggggugggcguguuccaggacggggucuuccacaccauguggcacgugacccgcggcgccgugcugauguaccagggcaagcggcuggagcccagcugggccuccgucaagaaggaccucaucagcuacgggggcggguggcgcuuccagggcuccuggaacacgggggaggagguccaggugaucgccgucgagcccggcaagaacccgaagaacgugcagaccacccccggcaccuucaagacgcccgagggggaggugggcgccaucgcgcuggacuucaagcccgggaccagcggcuccccgaucgucaaccgggagggcaagaucguggggcuguacggcaacgggguggucaccaccagcggcacguacguguccgccaucgcccaggccaaggccagccaggaggggccccuccccgagaucgaggacgagguguucaagaagcgcaaccugaccaucauggaccugcacccgggcagcggcaagacccggcgcuaccuccccgcgaucguccgggaggccaucaagcgcaagcugcgcacccugauccucgcccccacgcgggugguggccuccgagauggcggaggcccugaaggggaugcccauccgcuaccagaccaccgccgucaagagcgagcacaccggccgggagaucguggaccugaugugccacgccacguucaccaugcgccuccuguccccggugcggguccccaacuacaacaugaucaucauggacgaggcccacuucaccgaccccgcgagcaucgccgcccgcggguacaucuccacccgggugggcaugggggaggccgccgcgaucuucaugacggccacgccgcccggcagcguggaggccuucccccaguccaacgccgucauccaggacgaggagcgcgacauccccgagcggagcuggaacuccggcuacgacuggaucaccgacuuccccgggaagaccgugugguucgugcccagcaucaaguccggcaacgacaucgccaacugccugcgcaagaacgggaagcgggucauccagcucagccgcaagacguucgacaccgaguaccagaagaccaagaacaacgacugggacuacguggugaccacggacaucuccgagaugggcgcgaacuuccgggccgaccgcgucaucgacccccggcgcugccugaagcccgugauccugaaggacgggcccgagcgggucauccucgccggcccgaugcccgugaccguggccagcgcggcccagcgccggggccgcaucgggcgcaaccagaacaaggagggcgaccaguacgucuacauggggcagccccugaacaacgacgaggaccacgcccacuggaccgaggccaagaugcugcucgacaacaucaacacccccgagggcaucaucccggcccuguucgagcccgagcgggagaaguccgcggccaucgacggggaguaccgccugcggggcgaggcccgcaagacguucguggagcucaugcggcgcggcgaccugcccguguggcugagcuacaaggucgccuccgagggguuccaguacagcgaccggcgcuggugcuucgacggcgagcggaacaaccaggugcucgaggagaacauggacguggagaucuggaccaaggagggggagcgcaagaagcugcggccccgcuggcuggacgcccggaccuacuccgacccgcucgcgcugcgcgaguucaaggaguucgccgccggccggcgcagcgucagcggcgaccugauccucgagaucgggaagcugccccagcaccugacccuccgggcccagaacgcccuggacaaccuggugaugcuccacaacuccgagcagggcgggaaggcguaccgccacgccauggaggagcugcccgacaccaucgagacgcugaugcuccuggcccugaucgccgugcucaccggcggggucacccuguucuuccugagcggcaagggccucgggaagaccuccaucggccugcugugcgugacggcgagcuccgcccuccuguggauggccagcguggagccccacuggaucgccgccuccaucauccuggaguucuuccucaugguccugcugaucccggagcccgaccggcagcgcacgccccaggacaaccagcucgcguacguggugaucgggcugcuguucaugauccucaccgucgccgccaacgagaugggccugcuggagaccacgaagaaggaccucgggaucggcuacguggccgccgagaaccaccagcacgcgaccaugcuggacguggaccugcacccggccagcgccuggacccucuacgccgucgccaccacggugaucacccccaugaugcggcacaccaucgagaacaccacggcgaacaucucccugaccgccaucgccaaccaggccgccauccugaugggccucgacaagggguggcccaucagcaagauggacaucggcgugccccugcuggcgcucgggugcuacucccaggucaacccgcugacccugaccgccgccgugcucaugcugguggcccacuacgcgaucaucggccccgggcugcaggccaaggccacgcgcgaggcccagaagcgcaccgccgcgggcaucaugaagaaccccaccgucgacggcaucguggccaucgaccucgaccccguggucuacgacgccaaguucgagaagcagcuggggcagaucaugcugcucauccugugcaccagccagauccugcucaugcggacgaccugggcccugugcgaguccaucacccuggccaccggcccgcucacgacccugugggaggggagccccggcaaguucuggaacaccaccaucgcgguguccauggccaacaucuuccgcggcagcuaccuggccggggccggccucgccuucucccugaugaagucccucgggggcgggcggcgcgggacgggcgcgcagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgucagccggggcaccgccaagcugcgcugguucguggagcggaaccuggugaagcccgagggcaaggucaucgaccuggggugcggccgcgggggcugguccuacuacugcgcggggcucaagaaggugaccgaggugaagggcuacaccaagggcgggcccggccacgaggagccgauccccauggccaccuacggguggaaccuggucaagcugcacagcggcaaggacguguucuucaugccgcccgagaagugcgacacgcuccugugcgacaucggggaguccagcccgaaccccaccaucgaggagggccggacccugcgcgugcucaagauggucgagcccuggcugcggggcaaccaguucugcaucaagauccugaaccccuacaugccguccgugguggagacccucgagcagaugcagcgcaagcacgggggcaugcugguccggaacccccugagccgcaacuccacgcacgagauguacugggugagcugcgggaccggcaacaucguguccgccgucaacaugaccagccggaugcuccugaaccgcuucaccauggcccaccgcaagcccacguacgagcgggacguggaccugggcgccgggacccgccacguggcggucgagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccugcugacgaagcccugggacgugauccccauggugacccagaucgccaugaccgacaccacgccguucggccagcagcgggucuucaaggagaagguggacacccgcacgccccgggcgaagcgcggcaccacgcagaucauggaggugaccgccaaguggcucuggggguuccugucccggaacaagaagccccgcaucugcacccgggaggaguucacccgcaagguccggagcaacgccgccaucggcgccguguucguggacgagaaccaguggaacagcgcgaaggaggccgucgaggacgagcgcuucugggaccuggugcaccgggagcgcgagcuccacaagcaggggaagugcgccacgugcguguacaacaugaugggcaagcgggagaagaagcugggggaguucggcaaggccaagggcucccgcgcgaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgccggcugggacacccgcaucaccgaggacgaccuccagaacgaggcgaagaucacggacaucauggagcccgagcacgcccugcuggccaccagcaucuucaagcucaccuaccagaacaagguggugcgcguccagcggcccgccaagaacgggaccgugauggacgugaucucccgccgggaccagcgcggcagcggccaggucgggacguacggccugaacaccuucaccaacauggaggugcagcugauccggcagauggaguccgaggggaucuuccuccccagcgagcuggagaccccgaaccuggccgagcgcgcgcucgacuggcuggagaagcacggcgccgagcggcugaagcgcauggccaucuccggggacgacugcguggucaagcccaucgacgaccgguucgccacggcccucaccgcgcugaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcucgugggccgggcccgcgucagccagggggccggcuggucccugcgggagaccgccugccugggcaagagcuacgcccagauguggcagcucauguacuuccaccgccgggaccugcgccuggcggccaacgccaucugcuccgccgugcccguggacuggguccccaccagccggaccacguggagcauccacgcgcaccaccaguggaugaccaccgaggacaugcucuccguguggaaccgcguguggaucgaggagaacccguggauggaggacaagacccacgucagcuccugggaggaggugcccuaccugggcaagcgcgaggaccaguggugcggcagccugaucgggcucacggcccgggccaccugggccaccaacauccagguggccaucaaccagguccgccggcugaucggcaacgagaacuaccuggacuacaugaccuccaugaagcgcuucaagaacgagagcgaccccgagggggcgcucugguga

SEQ ID NO: 8232 - RNA, 9879 nt, Artificial Sequence
  derived and/or modified CDS sequence (opt1) from DENV-1__EU482611__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaagcucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggggugcuggagagcgagaugaucauccccaagaucuacggcgggccgaucucccagcacaacuaccggcccggcuacuucacccagaccgccgggcccuggcaccugggcaagcucgagcuggacuucgaccugugcgagggcacgaccguggucguggacgagcacugcgggaaccgcggcccgagccuccggaccaccacggugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggcauccugugcgugagcaucaugaucgaggaggugaugcggucccgcuggagccgcaagaugcucaugaccgggacgcuggccgucuuccugcuccugaucaugggccagcugaccuggaacgaccucauccggcugugcaucauggugggggccaacgcguccgaccgcaugggcaugggcaccaccuaccuggcccucauggccacguucaagaugcggccgauguucgccguggggcugcuguuccgccggcucaccagccgcgagguccugcugcucaccaucggccugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgcgacgacacccucaccauccugcugaaggccacccuccuggccguguccggggucuaccccaugagcauccccgcgacgcuguucgugugguacuucuggcagaagaagaagcagcgguccggcgugcucugggacacccccagcccgcccgaggucgagcgcgccgugcuggacgacggcaucuaccggauccugcagcgcgggcugcucggccggucccaggugggggucggcguguuccaggacgggguguuccacaccauguggcacgucacccgcggcgccgugcugauguaccagggcaagcggcuggagcccagcugggccuccgugaagaaggaccucaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgggagggcaagaucgucgggcuguacggcaacgggguggugaccaccagcggcacguacgucuccgccaucgcccaggccaaggcgagccaggaggggccccuccccgagaucgaggacgagguguucaagaagcgcaaccugaccaucauggaccugcacccgggcagcggcaagacccggcgcuaccuccccgccaucgugcgggaggccaucaagcgcaagcugcgcacccugauccucgcccccacgcgggucguggcguccgagauggccgaggcccugaaggggaugcccauccgcuaccagaccaccgccgucaagagcgagcacaccggccgggagaucgucgaccugaugugccacgccacguucaccaugcgccuccuguccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcucagccgcaagacguucgacaccgaguaccagaagaccaagaacaacgacugggacuacgucgugaccacggacaucuccgagaugggcgccaacuuccgggccgaccgcgugaucgacccccggcgcugccugaagcccgucauccugaaggacgggcccgagcgggugauccucgccggcccgaugcccgucaccguggcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucgucgagcucaugcggcgcggcgaccugcccguguggcugagcuacaagguggccuccgagggguuccaguacagcgaccggcgcuggugcuucgacggcgagcggaacaaccagguccucgaggagaacauggacguggagaucuggaccaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggucaugcuccacaacuccgagcagggcgggaaggccuaccgccacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucgggcugcuguucaugauccucaccguggccgccaacgagaugggccugcuggagaccacgaagaaggaccucgggaucggcuacgucgccgcggagaaccaccagcacgccaccaugcuggacguggaccugcacccggccagcgccuggacccucuacgccguggcgaccacggucaucacccccaugaugcggcacaccaucgagaacaccacggccaacaucucccugaccgccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacgcgcgaggcccagaagcgcaccgcggccggcaucaugaagaaccccaccguggacggcaucgucgccaucgaccucgaccccgugguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccgucuccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgugagccggggcaccgcgaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccggacccugcgcgugcucaagaugguggagcccuggcugcggggcaaccaguucugcaucaagauccugaaccccuacaugccguccgucguggagacccucgagcagaugcagcgcaagcacgggggcaugcuggugcggaacccccugagccgcaacuccacgcacgagauguacugggucagcugcgggaccggcaacaucguguccgccgugaacaugaccagccggaugcuccugaaccgcuucaccauggcccaccgcaagcccacguacgagcgggacgucgaccugggcgcggggacccgccacguggccguggagcccgaggucgccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccugcugacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcucuggggguuccugucccggaacaagaagccccgcaucugcacccgggaggaguucacccgcaaggugcggagcaacgccgccaucggcgcggucuucguggacgagaaccaguggaacagcgccaaggaggccguggaggacgagcgcuucugggaccugguccaccgggagcgcgagcuccacaagcaggggaagugcgccacgugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggagguccagcugauccggcagauggaguccgaggggaucuuccuccccagcgagcuggagaccccgaaccuggcggagcgcgcccucgacuggcuggagaagcacggcgccgagcggcugaagcgcauggccaucuccggggacgacugcguggugaagcccaucgacgaccgguucgccacggcgcucaccgcccugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggccggcuggucccugcgggagaccgccugccugggcaagagcuacgcgcagauguggcagcucauguacuuccaccgccgggaccugcgccuggccgccaacgccaucugcuccgcgguccccguggacugggugcccaccagccggaccacguggagcauccacgcccaccaccaguggaugaccaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucacggcccgggccaccugggccaccaacauccagguggcgaucaaccaggugcgccggcugaucggcaacgagaacuaccuggacuacaugaccuccaugaagcgcuucaagaacgagagcgaccccgagggggcccucugguga

SEQ ID NO: 8233 - RNA, 9879 nt, Artificial Sequence
  derived and/or modified CDS sequence (opt1) from DENV-1__FJ639735__SS-prME
agcgugaccaugcugcucaugcugcugcccaccgcccucgccuuccaccugacgacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaccgcccuguuccucgcgcacgccaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgcggugcuccggaagcugugcaucgaggccaagaucagcaacaccacgaccgacucccgcugccccacccagggcgaggccacccugguggaggagcaggacgccaacuucgucugccggcgcacguucguggaccggggcugggggaacggcugcggccucuucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgcgaccaucacgccccaggcccccaccagcgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcaccuccuacgucaugugcacggggagcuucaagcuggagaaggagguggcggagacccagcacggcaccgugcugguccaggugaaguacgagggcaccgacgcccccugcaagauccccuucuccacgcaggacgagaagggggugacccagaacggccggcucaucaccgccaacccgaucgucaccgacaaggagaagcccgugaacaucgagacggagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcguguucaccuccguggggaagcugguccaccagguguucggcacggccuacggggugcuguucagcggcgucuccuggaccaugaagaucgggaucggcauccuccugaccuggcugggccucaacagccgcuccaccagccuguccaugacgugcaucgccguggggauggugacccuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacgcgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcuccgggacuccuacacccagaugugcgaccaccgccugaugagcgcggccaucaaggacuccaaggccgugcacgccgacaugggcuacuggaucgagagcgagaagaacgagacguggaagcuggcccgggcguccuucaucgaggugaagaccugcaccuggcccaagagccacacccucugguccaacggcguccuggagagcgagaugaucauccccaagaucuacgggggcccgaucucccagcacaacuaccgccccggguacuucacgcagaccgccggccccuggcaccuggggaagcucgagcuggacuucaaccugugcgagggcaccaccgugguggucgacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgugaaggagaaggaggagaaccucguccggagcaugguguccgccggcagcggcgagguggacagcuucucccuggggauccugugcgucagcaucaugaucgaggaggugaugcgcucccgguggagccgcaagaugcucaugaccggcacccuggccguguuccugcuccugaucauggggcagcugaccuggaacgaccucauccgccugugcaucauggucggcgccaacgcguccgaccggauggggaugggcacgaccuaccuggcccucauggccaccuucaagaugcgcccgauguucgccgugggccugcuguuccggcgccucaccagccgggaggugcugcugcucacgaucgggcugucccuggucgccagcguggagcuccccaacucccuggaggagcugggcgacgggcucgcgaugggcaucaugaugcugaagcugcucaccgaguuccagccccaccagcuguggaccacccugcucagccugacguucaucaagaccacccugucccucgacuacgccuggaagaccacggccauggcccugagcaucgucucccuguucccccucugccugagcaccaccucccagaagaccaccuggcugccggugcuccugggcagcuucgggugcaagccccugacgauguuccucaucaccgagaacaagaucuggggccgcaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagaaggacgacacgcucaccauccugcugaaggccacccuccuggccguguccggcgucuaccccaugagcauccccgcgacccuguucgugugguacuucuggcagaagaagaagcagcgguccggggugcucugggacacgcccagcccgcccgaggucgagcgcgccgugcuggacgacggcaucuaccggauccugcagcgcggccugcucgggcggucccaggugggcgucgggguguuccaggacggcguguuccacaccauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagacgacccccggcaccuucaagacccccgagggcgaggugggggcgaucgcccuggacuucaagcccggcacgagcggguccccgaucgugaaccgggagggcaagaucgucggccuguacgggaacggcguggugaccaccagcgggaccuacgucuccgccaucgcccaggccaaggcgagccaggagggcccccuccccgagaucgaggacgagguguucaagaagcgcaaccugacgaucauggaccugcacccggggagcggcaagacccggcgcuaccuccccgccaucgugcgggaggccaucaagcgcaagcugcggacccugauccucgcccccacccgcgucguggcguccgagauggccgaggcccugaagggcaugcccauccgcuaccagacgaccgccgucaagagcgagcacaccgggcgggagaucgucgaccugaugugccacgccaccuucacgaugcgccuccuguccccggugcgggugcccaacuacaacaugaucgucauggacgaggcgcacuucaccgaccccgccagcaucgccgcccgcggcuacaucuccacccggguggggaugggcgaggccgcggccaucuucaugaccgccacgcccccggggagcguggaggccuucccccaguccaacgccgucauccaggacgaggagcgcgacauccccgagcggagcuggaacuccggcuacgacuggaucaccgacuuccccggcaagaccgugugguucgugccgagcaucaaguccgggaacgacaucgcgaacugccugcgcaagaacggcaagcgggucauccagcucagccgcaagaccuucgacacggaguaccagaagaccaagaacaacgacugggacuacguggugaccaccgacaucuccgagaugggggccaacuuccgggccgaccgcgucaucgacccccggcgcugccugaagcccgugauccugaaggacggccccgagcgggugauccucgccgggccgaugcccgucacgguggcgagcgccgcccagcgccggggccgcaucggccggaaccagaacaaggagggggaccaguacgucuacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgucagcggcgaccugauccucgagaucggcaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcggugcucaccggcggggucacccuguucuuccugagcgggaaggggcucggcaagaccuccaucgggcugcugugcgugaccgccagcuccgcccuccuguggauggccagcguggagccccacuggaucgccgcguccaucauccuggaguucuuccucaugguccugcugaucccggagcccgaccggcagcgcacgccccaggacaaccagcucgccuacguggugaucggccugcuguucaugauccucaccgucgccgccaacgagauggggcugcuggagaccaccaagcgggaccucggcaucgggcacguggccgcggagaaccaccagcacgccacgaugcuggacguggaccugcgcccggccagcgccuggacccucuacgccgucgcgaccaccgugaucacgcccaugaugcggcacaccaucgagaacaccaccgccaacaucucccugacggccaucgccaaccaggccgcgauccugaugggccucgacaagggcuggcccaucagcaagauggacaucggggugccccugcuggcccucggcugcuacucccaggucaacccgcugacccugaccgccgccgugcucaugcugguggcgcacuacgccaucaucgggcccggccugcaggccaaggccacccgcgaggcccagaagcgcacggcggccgggaucaugaagaaccccaccgucgacggcaucguggccaucgaccucgaccccguggucuacgacgccaaguucgagaagcagcugggccagaucaugcugcucauccugugcaccagccagauccugcucaugcggaccacgugggcccugugcgaguccaucacccuggcgaccgggccgcucaccacgcugugggagggcagccccgggaaguucuggaacaccaccaucgccguguccauggccaacaucuuccgcggcagcuaccuggccggcgccgggcucgcguucucccugaugaagucccugggcgggggccggcgcgggaccggcgcccagggcgagacgcucggggagaaguggaagcggcagcugaaccagcuguccaagagcgaguucaacaccuacaagcgcagcggcaucauggagguggaccgguccgaggccaaggaggggcucaagcgcggcgagaccaccaagcacgccgucagccgggggaccgcgaagcugcgcugguucguggagcggaaccuggugaagcccgagggcaaggucaucgaccugggcugcgggcgcggcgggugguccuacuacugcgccggccucaagaaggugacggaggugaagggguacaccaagggcggccccgggcacgaggagccgauccccauggccaccuacggcuggaaccuggucaagcugcacagcgggaaggacguguucuucaugccgcccgagaagugcgacacccuccugugcgacaucggcgaguccagcccgaaccccacgaucgaggaggggcggacccugcgcgugcucaagauggucgagcccuggcugcggggcaaccaguucugcaucaagauccugaaccccuacaugccguccgugguggagacccucgagcagaugcagcgcaagcacggcgggaugcugguccggaacccccugagccgcaacuccacccacgagauguacugggugagcugcggcacggggaacaucguguccgccgucaacaugaccagccggaugcuccugaaccgcuucaccauggcccaccgcaagcccaccuacgagcgggacguggaccugggcgcgggcacgcgccacguggccgucgagcccgagguggccaaccucgacaucaucgggcagcggaucgagaacaucaagaacgagcacaaguccaccuggcacuacgacgaggacaacccguacaagaccugggccuaccacggcagcuacgaggugaagcccuccgggagcgccuccagcauggucaacggcgugguccgccugcugaccaagcccugggacgugauccccauggugacgcagaucgcgaugaccgacaccaccccguucgggcagcagcgggucuucaaggagaagguggacacgcgcacgccccgggccaagcgcggcaccacccagaucauggaggugacggccaaguggcucuggggcuuccugucccggaacaagaagccccgcaucugcacccgggaggaguucacccgcaagguccggagcaacgccgccaucggggcgguguucguggacgagaaccaguggaacagcgccaaggaggccgucgaggacgagcgcuucugggaccuggugcaccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgccgacgacacggcggggugggacacccgcaucaccgaggacgaccuccagaacgaggccaagaucaccgacaucauggagcccgagcacgcccugcuggccacgagcaucuucaagcucaccuaccagaacaagguggugcgcguccagcggcccgccaagaacggcaccgugauggacgugaucucccgccgggaccagcgcgggagcggccaggucggcaccuacgggcugaacacguucaccaacauggaggugcagcugauccggcagauggaguccgagggcaucuuccuccccagcgagcuggagaccccgaaccuggcggagcgcgugcucgacuggcuggagaagcacggggccgagcggcugaagcgcauggccaucuccggcgacgacugcgucgugaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagacggccugccugggcaagagcuacgcccagauguggcagcucauguacuuccaccgccgggaccugcgccuggcggccaacgccaucugcuccgccgugcccgucgacugggugcccaccagccggaccaccuggagcauccacgcgcaccaccaguggaugacgaccgaggacaugcucuccguguggaaccgcgucuggaucgaggagaacccguggauggaggacaagacccacgugagcuccugggaggaggugcccuaccuggggaagcgcgaggaccaguggugcggcagccugaucggccucaccgcccgggccacgugggccaccaacauccaggucgccaucaaccaggugcgccggcugaucgggaacgagaacuaccuggacuacaugaccuccaugaagcgcuucaagaacgagagcgaccccgagggcgcgcucugguga

SEQ ID NO: 8234 - RNA, 9879 nt, Artificial Sequence
  derived and/or modified CDS sequence (opt1) from DENV-1__FJ639740__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcacccucguggaccggggcugggggaacggcugcgggcuguucggcaaggggagccugcucacgugcgccaaguucaagugcgugaccaagcuggagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcucaccgacuacggggcccugacccuggacugcagcccccgcaccggccucgacuucaacgagaugguccugcugacgaugaaggagaaguccuggcucgugcacaagcagugguuccuggaccugccgcuccccuggaccuccggggccagcaccagccaggagaccuggaaccggcaggaccugcuggugacguucaagaccgcccacgcgaagaagcaggaggucguggugcucggcucccaggagggcgccaugcacaccgcccugaccggggccacggagauccagaccagcggcaccaccacgaucuucgccgggcaccugaagugccgccucaagauggacaagcugacccugaagggcauguccuacgucaugugcaccgggagcuucaagcuggagaaggagguggcggagacccagcacggcacggugcucguccaggugaaguacgagggcaccgacgcccccugcaagauccccuucgccacccaggacgagaagggggugacccagaacggccggcugaucacggccaacccgaucgucaccgacaaggagaagcccgugaacaucgagaccgagccgcccuucggggaguccuacaucguggucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagguguucggcaccgccuacgggguccuguucuccggcgucagcuggaccaugaagaucgggaucggcauccugcugacguggcucggccugaacucccgcagcaccucccugagcaugaccugcaucgccguggggauggugacccucuaccugggcgucauggugcaggccgacuccgggugcgugaucaacuggaagggccgggagcugaagugcgggagcggcaucuucgucacgaacgaggugcacaccuggaccgagcaguacaaguuccaggcggacuccccgaagcgccucagcgccgccaucggcaaggccugggaggagggggugugcggcauccggagcgccacccgccuggagaacaucauguggaagcagaucuccaacgagcugaaccacauccuccuggagaacgacaugaaguucaccgucguggugggggacgcgaacggcauccuggcccaggggaagaagaugauccggccccagcccauggagcacaaguacagcuggaaguccuggggcaaggccaagaucaucggcgccgacauccagaacacgaccuucaucaucgacgggcccgacaccccggagugccccgacggccagcgcgcguggaacaucugggaggucgaggacuacggguucggcaucuucaccacgaacaucuggcucaagcugcgggacagcuacacccagaugugcgaccaccgccugauguccgccgccaucaaggacagcaaggccgugcacgccgacaugggcuacuggaucgaguccgagaagaacgagaccuggaagcucgcgcgggccagcuucaucgaggugaagaccugcacguggcccaagucccacacccuguggagcaacgggguccuggaguccgagaugaucauccccaagaucuacggcgggccgaucagccagcacaacuaccgccccggcuacuucacccagaccgccgggcccuggcaccucggcaagcuggagcuggacuucgaccucugcgagggcacgaccgugguggucgacgagcacugcgggaaccggggcccgucccugcgcaccaccacggugaccgggaagaucauccacgaguggugcugccggagcugcacccugccgccccugcgcuuccggggcgaggacgggugcugguacggcauggagauccgccccgugaaggagaaggaggagaaccugguccgguccauggugagcgccggcuccggggagguggacagcuucagccugggcauccucugcgucuccaucaugaucgaggaggugaugcgcagccgguggucccgcaagaugcugaugaccgggacgcuggccguguuccuccugcugaucaugggccagcucaccuggaacgaccugauccgccugugcaucauggucggggcgaacgccagcgaccggaugggcaugggcaccaccuaccucgcccugauggccacguucaagaugcgcccgauguucgccguggggcuccucuuccggcgccugaccucccgggaggugcugcuccugaccaucggccugagccucgucgcguccguggagcugcccaacagccuggaggagcucggggacggccuggccaugggcaucaugaugcugaagcuccugaccgaguuccagccccaccagcuguggacgacccuccugucccugaccuucgucaagaccacgcucagccuggacuacgccuggaagaccaccgccauggugcuguccaucgugagccucuucccccugugccuguccaccacgagccagaagaccaccuggcucccgguccugcugggguccuucggcugcaagccccucaccauguuccugaucaccgagaacaagaucugggggcgcaagagcuggccccugaacgagggcaucauggcgaucgggaucguguccauccuccugagcucccugcucaagaacgacgugccccuggccggcccgcugaucgccggcgggaugcucaucgccugcuacgucaucagcggcagcuccgccgaccugagccuggagaaggcggccgagguguccugggagcaggaggccgagcacagcggggccucccacaacauccucguggagguccaggacgacggcacgaugaagaucaaggacgaggagcgggacgacacccugaccauccugcucaaggccacccugcuggcggugagcgggguguaccccauguccauccccgccacccucuucgucugguacuucuggcagaagaagaagcagcgcagcggcgugcugugggacacccccuccccgcccgagguggagcgggccguccuggacgacggcaucuaccgcauccugcagcgggggcuccugggccgcagccaggugggggugggcgucuuccaggacgggguguuccacaccauguggcacgugacccggggcgccguccugauguaccagggcaagcgccucgagcccuccugggccagcgugaagaaggaccugaucuccuacgggggcggguggcgguuccagggcagcuggaacacgggggaggaggugcaggucaucgcgguggagcccggcaagaacccgaagaacgugcagaccacccccggcaccuucaagacgcccgagggggaggucggcgccaucgcccuggacuucaagcccgggaccuccggcagcccgaucgugaaccgcgagggcaagaucguggggcucuacggcaacggggucgugaccaccuccggcacguacgugagcgccaucgcccaggcgaaggccucccaggaggggccccugcccgagaucgaggacgaggucuucaagaagcggaaccugaccaucauggaccuccacccgggcagcggcaagacccgccgguaccugcccgccaucgugcgcgaggccaucaagcggaagcugcgcacccucauccuggcgcccacgcgcguggucgccagcgagauggccgaggcccugaaggggaugcccauccgguaccagaccaccgccgugaaguccgagcacaccggccgcgagaucguggaccucaugugccacgcgacguucaccaugcggcugcugagcccgguccgcgugcccaacuacaacaugaucaucauggacgaggcccacuucaccgaccccgccuccaucgccgcccggggguacaucagcacccgcgugggcaugggggaggcggccgccaucuucaugacggccacgccgcccggcuccgucgaggccuucccccagagcaacgcggugauccaggacgaggagcgggacauccccgagcgcuccuggaacagcggcuacgacuggaucaccgacuuccccgggaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccucaaggacgggcccgagcgcgucauccuggcgggcccgaugcccgugaccgucgccuccgccgcccagcggcgcggccggaucgggcgcaaccagaacaaggagggcgaccaguacguguacauggggcagccccugaacaacgacgaggaccacgcccacuggaccgaggcgaagaugcuccuggacaacaucaacacccccgagggcaucaucccggcccuguucgagcccgagcgcgagaaguccgccgccaucgacggggaguaccggcuccgcggcgaggcccggaagacguucguggagcugaugcgccggggcgaccugcccgucuggcucuccuacaagguggcgagcgagggguuccaguacuccgaccgccgguggugcuucgacggcgagcgcaacaaccaggugcuggaggagaacauggacgucgagaucuggaccaaggagggggagcggaagaagcugcgcccccgguggcucgacgcccgcaccuacagcgacccgcuggcccugcgggaguucaaggaguucgccgccggccgccgguccgugagcggcgaccucauccuggagaucgggaagcugccccagcaccucacccugcgcgcgcagaacgcccuggacaaccucgugaugcugcacaacagcgagcagggcgggaaggccuaccggcacgccauggaggagcugcccgacaccaucgagacgcucaugcugcuggcgcucaucgccguccugaccggcggggugacccuguucuuccucuccggcaagggccuggggaagaccagcaucggccugcucugcgugacggccuccagcgcccugcuguggauggccuccgucgagccccacuggaucgcggccagcaucauccucgaguucuuccugauggugcugcucaucccggagcccgaccgccagcggacgccccaggacaaccagcuggccuacguggucaucgggcuccucuucaugauccugaccguggccgccaacgagaugggccugcucgagaccacgaagaaggaccuggggaucggcuacguggcggccgagaaccaccagcacgccaccaugcuggacgucgaccuccgcccggccuccgccuggacccuguacgcgguggccaccacggugaucacccccaugaugcggcacaccaucgagaacaccacggccaacaucagccugaccgccaucgccaaccaggcggccauccucaugggccuggacaagggguggcccaucuccaagauggacaucggcgucccccugcucgcccuggggugcuacagccaggugaacccgcugacccucaccgccgcggugcugaugcuggucgcccacuacgccaucaucggccccgggcuccaggccaaggccacgcgcgaggcgcagaagcgcaccgccgccggcaucaugaagaaccccaccguggacggcaucguggccaucgaccuggaccccgucguguacgacgccaaguucgagaagcagcuggggcagaucaugcuccugauccugugcaccucccagauccuccugaugcggacgaccugggcgcugugcgagagcaucacccucgccaccggcccgcugacgacccugugggaggggucccccggcaaguucuggaacaccaccaucgccgugagcauggccaacaucuuccgcggcuccuaccucgccggggcgggccuggccuucagccugaugaagucccucgggggcgggcggcgcggcacgggcgcccagggggagacccugggcgagaaguggaagcggcagcugaaccagcucagcaaguccgaguucaacaccuacaagcgcagcgggaucauggaggucgaccggagcgaggccaaggagggccugaagcgcggggagaccacgaagcacgcggugucccggggcaccgccaagcugcgcugguucguggagcggaaccuggucaagcccgagggcaaggugaucgaccucgggugcggccgcgggggcuggagcuacuacugcgccgggcugaagaaggugaccgaggucaagggcuacaccaagggcgggcccggccacgaggagccgauccccauggccaccuacggguggaaccuggugaagcuccacuccggcaaggacguguucuucaugccgcccgagaagugcgacacgcugcugugcgacaucggggagagcuccccgaaccccaccaucgaggagggccggacccuccgcguccugaagaugguggagcccuggcugcggggcaaccaguucugcaucaagauccucaaccccuacaugccgagcguggucgagacccuggagcagaugcagcgcaagcacgggggcaugcuggugcggaacccccucucccgcaacagcacgcacgagauguacuggguguccugcgggaccggcaacaucgucagcgccgugaacaugaccucccggaugcugcugaaccgcuucaccauggcgcaccgcaagcccacguacgagcgggacguggaccucggcgccgggacccgccacgucgccguggagcccgaggaggccaaccuggacaucaucggccagcggaucgagaacaucaagaacgagcacaagagcaccuggcacuacgacgaggacaacccguacaagaccugggccuaccacggguccuacgaggugaagcccagcggcuccgcgagcuccauggucaacggggugguccgccugcucacgaagcccugggacgugauccccauggugacccagaucgccaugaccgacaccacgccguucggccagcagcgggucuucaaggagaagguggacacccgcacgccccgggccaagcgcggcaccacgcagaucauggaggugaccgccaaguggcuguggggguuccugagccggaacaagaagccccgcaucugcacccgggaggaguucacccgcaagguccgguccaacgccgcgaucggcgccguguucguggacgagaaccaguggaacagcgccaaggaggccgucgaggacgagcgcuucugggaccucgugcaccgggagcgcgagcugcacaagcaggggaagugcgcgacgugcguguacaacaugaugggcaagcgggagaagaagcugggggaguucggcaaggccaagggcagccgcgccaucugguacauguggcucggggcccgguuccuggaguucgaggcccugggcuucaugaacgaggaccacugguucucccgcgagaacagccucuccggggucgagggcgaggggcugcacaagcugggcuacauccuccgggacaucagcaagaucccgggcgggaacauguacgcggacgacaccgccggcugggacacccgcaucaccgaggacgaccugcagaacgaggccaagaucacggacaucauggagcccgagcacgcccugcucgccaccuccaucuucaagcugaccuaccagaacaagguggugcgcguccagcggcccgcgaagaacgggaccgugauggacgugaucagccgccgggaccagcgcggcuccggccaggucgggacguacggccugaacaccuucaccaacauggaggugcagcucauccggcagauggagagcgaggggaucuuccugcccuccgagcuggagaccccgaaccucgccgagcgcgugcuggacuggcuggagaagcacggcgccgagcggcucaagcgcauggccaucagcggggacgacugcgucgugaagcccaucgacgaccgguucgccacggcgcugaccgcccugaacgacaugggcaaggugcgcaaggacaucccccagugggagcccuccaagggcuggaacgacuggcagcaggucccguucugcagccaccacuuccaccagcucaucaugaaggacgggcgggagaucguggugcccugccgcaaccaggacgagcuggucggccgggcccgcgugucccagggggccggcuggagccugcgggagaccgccugccucgggaaguccuacgcgcagauguggcagcugauguacuuccaccgccgggaccugcgccucgccgccaacgccaucugcagcgcggugcccgucgacugggugcccaccucccggaccacguggagcauccacgcccaccaccaguggaugaccaccgaggacaugcugagcguguggaaccgcgucuggaucgaggagaacccguggauggaggacaagacccacguguccagcugggaggaggugcccuaccugggcaagcgcgaggaccaguggugcggcucccucaucgggcugacggcccgggccaccugggccaccaacauccaggucgcgaucaaccaggugcgccggcugaucggcaacgagaacuaccucgacuacaugaccagcaugaagcgcuucaagaacgaguccgaccccgagggggcccugugguga

SEQ ID NO: 8235 - RNA, 9879 nt, Artificial Sequence
  derived and/or modified CDS sequence (opt1) from DENV-1__FJ639741__SS-prME
agcgugaccauccugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccgggaccagcaccagccaggagacguggaaccggcaggaccuccuggugaccuucaagaccgcccacgccaagaagcaggaggucguggugcugggcucccaggagggcgcgaugcacaccgcccucacgggggccaccgagauccagaccagcggcaccacgaccaucuucgccgggcaccugaagugccgccugaagauggacaagcucacccugaagggcaccuccuacgucaugugcacggggagcuucaagcuggagaaggagguggccgagacccagcacggcaccgugcugguccaggugaaguacgagggcaccgacgcgcccugcaagauccccuucuccacgcaggacgagaagggggugacccagaacggccggcucaucaccgccaacccgaucgucaccgacaaggagaagcccgugaacaucgagacggagccgcccuucggggagagcuacaucguggucggcgccggcgagaaggcccugaagcuguccugguucaagaaggggagcuccaucggcaagauguucgaggcgaccgcccgcggggcccggcgcauggccauccucggcgacaccgccugggacuucgggagcaucggcggcguguucaccuccguggggaagcugguccaccagguguucggcacggcguacggggugcuguucagcggcgucuccuggaccaugaagaucgggaucggcauccuccugaccuggcugggccucaacagccgcuccaccagccuguccaugacgugcaucgccguggggauggugacccuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgcgaucggcaaggccugggaggagggggugugcggcauccgguccgccacgcgccucgagaacaucauguggaagcagaucagcaacgagcugaaccacauccugcucgagaacgacaugaaguucaccgucguggugggggacgccaacggcauccuggcccaggggaagaagaugauccggccccagcccauggagcacaaguacuccuggaaguccuggggcaaggcgaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggccaaggccuccuucaucgaggugaagaccugcaucuggcccaagagccacacccucugguccaacggcguccuggagagcgagaugaucauccccaagaucuacgggggcccgaucucccagcacaacuaccggcccggguacuucacccagacggcgggccccuggcaccuggggaagcucgagcuggacuucgaccugugcgagggcaccaccgugguggucgacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgugaaggagaaggaggagaaccucguccgcagcaugguguccgccggcagcggcgagguggacagcuucucccuggggauccugugcgucagcaucaugaucgaggaggugaugcggucccgcuggagccggaagaugcucaugacgggcacccuggccguguuccugcuccugaucauggggcagcugaccuggaacgaccucauccgccugugcaucauggucggcgccaacgccuccgaccgcauggggaugggcaccacguaccuggcgcucauggccaccuucaagaugcggccgauguucgccguggggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggaguuccagccccaccagcuguggaccacccugcucagccugaccuucaucaagacgacccugucccucgacuacgcguggaagaccaccgccaugguccugagcaucgugucccuguucccccucugccugagcacgaccucccagaagaccaccuggcugccggugcuccugggcagcuucgggugcaagccccugaccauguuccucaucacggagaacaagaucuggggccggaaguccuggccccugaacgaggggaucauggccaucggcaucgucagcauccugcucuccagccugcugaagaacgacgugccccucgccgggccgcugaucgcgggcggcaugcugaucgccugcuacgugaucagcggguccagcgccgaccucucccuggagaaggccgccgaggucagcugggagcaggaggcggagcacuccggcaccagccacaacauccugguggaggugcaggacgacgggaccaugaagaucaaggacgaggagcgcgacgacacccucacgauccugcugaaggccacccuccuggccgucuccggcguguaccccaugagcauccccgccacccuguucgugugguacuucuggcagaagaagaagcagcgguccgggguccucugggacacccccagcccgcccgagguggagcgcgccgugcuggacgacggcaucuaccggauccugcagcgcggccugcucgggcggucccaggucggcguggggguguuccaggacggcgucuuccacacgauguggcacgugacccgcggggcggugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagaccacgcccggcaccuucaagacccccgagggcgaggugggggccaucgcccuggacuucaagcccggcaccagcggguccccgaucgucaaccgggagggcaagaucgugggccuguacgggaacggcguggucacgaccagcgggaccuacguguccgcgaucgcccaggccaaggccagccaggagggcccccuccccgagaucgaggacgagguguucaagaagcgcaaccugaccaucauggaccugcacccggggagcggcaagacgcggcgcuaccuccccgccaucguccgggaggcgaucaagcgcaagcugcggacccugauccucgcccccacccgcgugguggccuccgagauggccgaggcgcugaagggcaugcccauccgcuaccagaccacggccgucaagagcgagcacaccgggcgggagaucguggaccugaugugccacgccaccuucaccaugcgccuccuguccccggugcggguccccaacuacaacaugaucaucauggacgaggcccacuucacggaccccgccagcaucgcggcccgcggcuacaucuccacccggguggggaugggcgaggccgccgccaucuucaugaccgcgacgccgcccgggagcguggaggccuucccccaguccaacgccgucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggccaacuuccgggcggaccgcgucaucgacccccggcgcugccugaagcccgugauccugaaggacggccccgagcgggugauccucgccgggccgaugcccgucaccguggccagcgccgcgcagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgccgcgaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcccugcgcgaguucaaggaguucgcggccgggcggcgcagcgucagcggcgaccugauccucgagaucggcaagcugccccagcaccugacgcuccgggcccagaacgcccuggacaaccuggugaugcuccacaacuccgagcagggcgggaaggccuaccgccacgcgauggaggagcugcccgacaccaucgagacccugaugcuccuggcccugaucgccgugcucaccgggggcgucacgcuguucuuccugagcgggaagggccucggcaagaccuccaucgggcugcugugcgugaccgccagcuccgcgcuccuguggauggccagcguggagccccacuggaucgccgccuccaucauccuggaguucuuccucaugguccugcugaucccggagcccgaccggcagcgcacgccccaggacaaccagcucgccuacguggugaucggccugcuguucaugauccucacggucgcggccaacgagauggggcugcuggagaccaccaagaaggaccucggcaucgggcacguggccgccgagaaccaccagcacgccaccaugcuggacguggaccugcggccggcgagcgccuggacgcucuacgccgucgccaccaccgugaucacccccaugaugcgccacacgaucgagaacaccaccgccaacaucucccugaccgcgaucgccaaccaggccgccauccugaugggccucgacaagggcuggcccaucagcaagauggacaucggggugccccugcuggcccucggcugcuacucccaggucaacccgcugacgcugaccgcggccgugcucaugcugguggcccacuacgccaucaucgggcccggccugcaggcgaaggccacccgggaggcccagaagcgcaccgccgccgggaucaugaagaaccccacggucgacggcaucguggcgaucgaccucgaccccguggucuacgacgccaaguucgagaagcagcugggccagaucaugcugcucauccugugcaccagccagauccugcucaugcgcaccaccugggcccugugcgaguccaucacgcuggccaccgggccgcucaccacccugugggagggcagccccgggaaguucuggaacacgaccaucgccguguccauggcgaacaucuuccggggcagcuaccuggccggcgccgggcucgccuucucccugaugaagucccugggcgggggccgccgggggaccggcgcccagggcgagacccucggggagaaguggaagcgccagcugaaccagcuguccaagagcgaguucaacacguacaagcggagcggcaucauggagguggaccgcuccgaggcgaaggaggggcucaagcggggcgagaccaccaagcacgccgucagccgcgggaccgccaagcugcggugguucguggagcgcaaccuggugaagcccgagggcaaggucaucgaccugggcugcgggcggggcgggugguccuacuacugcgccggccucaagaaggugaccgaggugaagggguacacgaagggcggccuggggcacgaggagcccaucccgauggcgaccuacggcuggaaccuggucaagcuccacagcgggaaggacguguucuucaugccgcccgagaagugcgacacccugcugugcgacaucggcgaguccagccccaacccgaccaucgaggaggggcgcacgcuccgggugcugaagauggucgagcccuggcugcgcggcaaccaguucugcaucaagauccucaaccccuacaugcccuccgugguggagacccuggagcagaugcagcggaagcacggcgggaugcugguccgcaacccgcucagccggaacuccacccacgagauguacugggugagcugcggcaccgggaacaucguguccgccgucaacaugacgagccgcaugcugcugaaccgguucaccauggcccaccgcaagcccaccuacgagcgcgacguggaccucggcgccggcacccggcacguggccgucgagcccgagguggcgaaccuggacaucaucgggcagcgcaucgagaacaucaagaacgagcacaaguccacguggcacuacgacgaggacaaccccuacaagaccugggccuaccacggcagcuacgaggugaagccguccgggagcgccuccagcauggucaacggcguggucaagcugcucaccaagcccugggacgugauccccauggugacccagaucgccaugacggacaccacccccuucgggcagcagcgggucuucaaggagaagguggacacccgcacgccgcgggccaagcgcggcaccacccagaucauggaggugaccgcgaaguggcuguggggcuuccugucccggaacaagaagccccgcaucugcacgcgggaggaguucacccgcaagguccggagcaacgccgccaucggggccguguucguggacgagaaccaguggaacagcgccaaggaggcggucgaggacgagcgcuucuggaaccucgugcaccgggagcgcgagcugcacaagcagggcaagugcgcgaccugcguguacaacaugauggggaagcgggagaagaagcugggcgaguucgggaaggccaagggcucccgcgccaucugguacauguggcucggcgcgcgguuccuggaguucgaggcccugggguucaugaacgaggaccacugguucagccgcgagaacucccucagcggcgucgagggggagggccugcacaagcugggguacauccuccgggacaucuccaagauccccggcggcaacauguacgccgacgacaccgccgggugggacacgcgcaucaccgaggacgaccugcagaacgaggccaagaucaccgacaucauggagccggagcacgcgcugcucgccaccagcaucuucaagcugacguaccagaacaagguggugcggguccagcgccccgccaagaacggcaccgugauggacgugaucucccgccgggaccagcgcgggagcggccaggucggcaccuacgggcugaacaccuucacgaacauggaggugcagcucauccggcagauggaguccgagggcaucuuccugcccagcgagcuggagacccccaaccucgccgagcgcgugcuggacuggcuggagaagcacggggccgagcggcucaagcgcauggcgaucuccggcgacgacugcgucgugaagccgaucgacgaccgguucgccaccgcccugaccgcccugaacgacauggggaaggugcgcaaggacaucccccagugggagcccagcaagggcuggaacgacuggcagcagguccccuucugcucccaccacuuccaccagcucaucaugaaggacggccgggagaucguggugccgugccgcaaccaggacgagcuggucgggcgggcccgcgugagccagggcgcgggguggucccugcgggagaccgccugccucggcaagagcuacgcccagauguggcagcugauguacuuccaccgccgggaccugcgccucgccgccaacgcgaucugcuccgccgugcccgucgacugggugcccacgagccggaccaccuggagcauccacgcccaccaccaguggaugaccacggaggacaugcuguccguguggaaccgcgucuggaucgaggagaaccccuggauggaggacaagacccacgugagcuccugggaggaggugccguaccuggggaagcgggaggaccaguggugcggcagccucaucggccugaccgcccgcgcgaccugggccacgaacauccaggucgccaucaaccaggugcgccggcugaucgggaacgagaacuaccucgacuacaugaccuccaugaagcgcuucaagaacgagagcgaccccgagggcgcccugugguga

SEQ ID NO: 8236 - RNA, 9879 nt, Artificial Sequence
  derived and/or modified CDS sequence (opt1) from DENV-1__FJ639743__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugauggcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugcgguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgguccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaaggucaucggcgccgacauccagaacacgaccuucaucaucgacgggcccgacaccccggagugccccgacggccagcgggccuggaacaucugggagguggaggacuacggguucggcaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccucugguccaacggggugcuggagagcgagaugaucauccccaagaucuacggcgggccgaucucccagcacaacuaccggcccggcuacuucacccagaccgccgggcccuggcaccugggcaagcucgagcuggacuucgaccugugcgagggcacgaccguggucguggacgagcacugcgggaaccgcggcccgagccuccggaccaccacggugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggcauccugugcgugagcaucaugaucgaggaggugaugcggucccgcuggagccgcaagaugcucaugaccgggacgcuggccgucuuccugcuccuggugaugggccagcugaccuggaacgaccucauccggcugugcaucauggugggggccaacgcguccgaccgcaugggcaugggcaccaccuaccuggcccucauggccacguucaagaugcggccgauguucgccgucgggcugcuguuccgccggcucaccagccgcgaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccaugguccugagcaucgugucccuguucccccucugccugagcaccacgucccagaagaccaccuggcugccggugcuccuggggagcuucggcugcaagccccugaccauguuccucaucaccgagaacaagaucugggggcggaaguccuggccccugaacgagggcaucauggccaucgggaucgucagcauccugcucuccagccugcugaagaacgacgugccccucgcgggcccgcugaucgccggcgggaugcugaucgccugcuacgugaucagcggcuccagcgccgaccucucccuggagaaggccgcggaggucagcugggagcaggaggccgagcacuccggggccagccacaacauccugguggaggugcaggacgacggcacgaugaagaucaaggacgaggagcgcgacgacacccucaccauccugcugaaggccacccuccuggccgucuccgggguguaccccaugagcauccccgcgacgcuguucgugugguacuucuggcagaagaagaagcagcgguccggcguccucugggacacccccagcccgcccgagguggagcgcgccgugcuggacgacggcaucuaccggauccugcagcgcgggcugcucggccggucccaggucggggugggcguguuccaggacggggucuuccacaccauguggcacgugacccgcggcgccgugcugauguaccagggcaagcggcuggagcccagcugggccuccgucaagaaggaccucaucagcuacgggggcggguggcgcuuccagggcuccuggaacacgggggaggagguccaggugaucgccgucgagcccggcaagaacccgaagaacgugcagaccacccccggcaccuucaagacgagcgagggggaggugggcgcgaucgcccuggacuucaagcccgggaccuccggcagccccaucgucaaccgggagggcaagaucguggggcuguacggcaacgggguggucaccaccuccggcacguacgugagcgccaucgcccaggccaaggcgagccaggaggggccgcuccccgagaucgaggacgagguguucaagaagcgcaaccugaccaucauggaccugcaccccggcuccggcaagacccggcgcuaccucccggccaucguccgggaggccaucaagcgcaagcugcgcacccugauccucgcccccacgcgggugguggcgagcgagauggccgaggcccugaaggggaugcccauccgcuaccagaccaccgccgucaaguccgagcacaccggccgggagaucguggaccugaugugccacgccacguucaccaugcgccuccugagccccgugcgggucccgaacuacaacaugaucaucauggacgaggcgcacuucaccgaccccgccuccaucgccgcccgcggguacaucagcacccgggugggcaugggggaggccgcggccaucuucaugacggccacgccgcccggcuccguggaggccuucccgcagagcaacgccgucauccaggacgaggagcgcgacauccccgagcgguccuggaacagcggcuacgacuggaucaccgacuuccccgggcgcaccgugugguucgugcccuccaucaagagcggcaacgacaucgcgaacugccugcggaagaacgggaagcgcgucauccagcucucccggaagacguucgacaccgaguaccagaagaccaagaacaacgacugggacuacguggugaccacggacaucagcgagaugggcgccaacuuccgcgccgaccgggucaucgacccgcgccggugccugaagcccgugauccugaaggacgggcccgagcgcgucauccucgccggccccaugccggugaccguggcguccgccgcccagcggcgcggccgcaucgggcggaaccagaacaaggagggcgaccaguacgucuacauggggcagccccugaacaacgacgaggaccacgcccacuggaccgaggccaagaugcugcucgacaacaucaacacccccgagggcaucauccccgcgcuguucgagccggagcgcgagaaguccgccgccaucgacggggaguaccggcugcgcggcgaggcccggaagacguucguggagcucaugcgccggggcgaccugcccguguggcuguccuacaaggucgccagcgagggguuccaguacuccgaccgccgguggugcuucgacggcgagcgcaacaaccaggugcucgaggagaacauggacguggagaucuggaccaaggagggggagcggaagaagcugcgcccccgguggcuggacgcgcgcaccuacagcgacccccucgcccugcgggaguucaaggaguucgccgccggccgccggagcgucuccggcgaccugauccucgagaucgggaagcugccgcagcaccugacccuccgcgcccagaacgcgcuggacaaccuggugaugcuccacaacagcgagcagggcgggaaggccuaccggcacgccauggaggagcugcccgacaccaucgagacgcugaugcuccuggcccugaucgcggugcucaccggcggggucacccuguucuuccuguccggcaagggccucgggaagaccagcaucggccugcugugcgugacggccuccagcgcccuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucaccgucgccgccaacgagaugggccugcuggagaccacgaagaaggaccucgggaucggcuacguggccgcggagaaccaccagcacgccaccaugcuggacguggaccugcgccccgccuccgccuggacccucuacgccgucgcgaccacggugaucaccccgaugaugcgccacaccaucgagaacaccacggccaacaucagccugaccgccaucgccaaccaggccgcgauccugaugggccucgacaagggguggcccaucuccaagauggacaucggcgugccccugcuggcccucgggugcuacagccaggucaacccccugacccugaccgccgccgugcucaugcugguggcgcacuacgccaucaucggcccggggcugcaggccaaggccacgcgggaggcccagaagcgcaccgcggccggcaucaugaagaaccccaccgucgacggcaucguggccaucgaccucgaccccguggucuacgacgccaaguucgagaagcagcuggggcagaucaugcugcucauccugugcaccucccagauccugcucaugcggacgaccugggcccugugcgagagcaucacccuggcgaccggcccccucacgacccugugggagggguccccgggcaaguucuggaacaccaccaucgccgugagcauggccaacaucuuccgcggcuccuaccuggccggggccggccucgcguucagccugaugaagucccucgggggcgggcggcgcgggacgggcgcccagggggagacccucggcgagaaguggaagcggcagcugaaccagcugagcaagagcgaguucaacaccuacaagcgcuccgggaucauggagguggaccggagcgaggccaaggagggccucaagcgcggggagaccacgaagcacgccgucucccggggcaccgcgaagcugcgcugguucguggagcggaaccuggugaagcccgagggcaaggucaucgaccuggggugcggccgcgggggcuggagcuacuacugcgccgggcucaagaaggugaccgaggugaagggcuacaccaagggcgggcccggccacgaggagcccaucccgauggccaccuacggguggaaccuggucaagcugcacuccggcaaggacguguucuucaugagccccgagaagugcgacacgcuccugugcgacaucggggaguccagccccaaccccaccaucgaggagggccggacccugcgcgugcucaagauggucgagccguggcugcggggcaaccaguucugcaucaagauccugaaccccuacaugcccuccgugguggagacccucgagcagaugcagcgcaagcacgggggcaugcugguccggaacccccugagccgcaacuccacgcacgagauguacugggugagcugcgggaccggcaacaucguguccgccgucaacaugaccagccgcaugcuccugaaccgguucaccauggcccaccgcaagccgacguacgagcgggacguggaccugggcgcggggacccgccacguggccgucgagcccgaggaggccaaccucgacaucaucggccagcggaucgagaacauccgcaacgagcacaaguccaccuggcacuacgacgaggacaaccccuacaagaccugggccuaccacgggagcuacgaggugaagcccuccggcagcgccuccagcauggucaacgggguggugcggcugcugacgaagccgugggacgucauccccauggugacccagaucgcgaugaccgacaccacgcccuucggccagcagcgcguguucaaggagaaggucgacacccggacgccccgcgccaagcggggcaccacgcagaucauggaggugaccgccaaguggcucuggggguuccugagccgcaacaagaagccgcggaucugcacccgcgaggaguucacccggaaggugcgcuccaacgccgccaucggcgcggucuucguggacgagaaccaguggaacagcgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgcgagaacucccugagcgggguggagggcgaggggcuccacaagcugggcuacauccugcgggacaucuccaagauccccggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggucgugcgggugcagcgcccggccaagaacgggaccgucauggacgugaucucccggcgcgaccagcggggcagcggccagguggggacguacggccugaacaccuucaccaacauggagguccagcugauccgccagauggaguccgaggggaucuuccuccccagcgagcuggagacccccaaccuggcggagcgggugcucgacuggcuggagaagcacggcgccgagcgccugaagcggauggccaucuccggggacgacugcguggucaagcccaucgacgaccgcuucgccacggcccucaccgcgcugaacgacaugggcaaggugcggaaggacaucccgcagugggagcccagcaagggcuggaacgacuggcagcagguccccuucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcccagauguggcagcucauguacuuccaccggcgcgaccugcgccuggcggccaacgccaucugcagcgccgugccgguggacuggguccccaccucccggaccacguggagcauccacgcgcaccaccaguggaugaccaccgaggacaugcucuccguguggaaccgcguguggaucgaggagaaccccuggauggaggacaagacccacgucagcuccugggaggaggugcccuaccugggcaagcgggaggaccaguggugcggcagccugaucgggcucacggcccgcgccaccugggccaccaacauccagguggccaucaaccagguccggcgccugaucggcaacgagaacuaccuggacuacaugaccuccaugaagcgguucaagaacgagagcgacccggagggggcgcucugguga

SEQ ID NO: 8237 - RNA, 9879 nt, Artificial Sequence
  derived and/or modified CDS sequence (opt1) from DENV-1__FJ639794__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgugguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccuggcccaggggaagaagaugauccggccccagcccauggagcacaaguacuccuggaaguccuggggcaaggcgaagaucaucggcgccgacauccagaacacgaccuucaucaucgacgggcccgacaccccggagugccccgacggccagcgcgccuggaacaucugggagguggaggacuacggguucggcaucuucaccacgaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagaccugcacguggcccaagagccacacccucugguccaacggggugcuggagagcgagaugaucauccccaagaucuacggcgggccgaucucccagcacaacuaccgccccggcuacuucacccagaccgcggggcccuggcaccugggcaagcucgagcuggacuucgaccugugcgagggcacgaccguggucguggacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugaccgggacgcuggccgucuuccugcuccugaucaugggccagcugaccuggaacgaccucauccgccugugcaucauggugggggccaacgccuccgaccggaugggcaugggcaccaccuaccuggcgcucauggccacguucaagaugcgcccgauguucgccguggggcugcuguuccggcgccucaccagccgggagguccugcugcucaccaucgggcugucccugguggccagcgucgagcuccccaacucccuggaggagcugggggacggccucgccaugggcaucaugaugcugaagcugcucaccgaguuccagccccaccagcuguggacgacccugcucagccugaccuucgugaagaccacgcugucccucgacuacgcguggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgucccccucgccggcccgcugaucgcgggcgggaugcugaucgccugcuacgugaucagcggcuccagcgccgaccucucccuggagaaggccgccgaggugagcugggagcaggaggcggagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgccacgcuguucgugugguacuucuggcagaagaagaagcagcgcuccggcgugcucugggacacccccagcccgcccgaggucgagcgggcggugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgccaucgcgcuggacuucaagcccgggaccagcggcuccccgaucgugaaccgcgagggcaagaucgucgggcuguacggcaacgggguggugaccaccagcggcacguacgucuccgccaucgcccaggccaaggccagccaggaggggccccuccccgagaucgaggacgagguguucaagaagcggaaccugaccaucauggaccugcacccgggcagcggcaagacccgccgguaccuccccgcgaucgugcgcgaggccaucaagcggaagcugcgcacccugauccucgcccccacgcgcgucguggccuccgagauggcggaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcccacuucaccgaccccgcgagcaucgccgcccggggguacaucuccacccgcgucggcaugggggaggccgccgcgaucuucaugacggccacgccgcccggcagcguggaggccuucccccaguccaacgccgugauccaggacgaggagcgggacauccccgagcgcagcuggaaccugggcuacgacuggaucaccgacuuccccgggaagaccgucugguucgugcccuccaucaagagcggcaacgacaucgccaacugccuccggaagaacgggaagcgcgugauccagcugucccggaagacguucgacaccgaguaccagaagaccaagaacaacgacugggacuacgucgugaccacggacaucagcgagaugggcgcgaacuuccgcgccgaccgggugaucgacccccgccggugccugaagcccgucauccucaaggacgggcccgagcgcgugauccuggccggcccgaugcccgucaccguggccuccgcggcccagcggcgcggccggaucgggcgcaaccagaacaaggagggcgaccaguacguguacauggggcagccccugaacaacgacgaggaccacgcccacuggaccgaggccaagaugcuccuggacaacaucaacacccccgagggcaucaucccggcccuguucgagcccgagcgcgagaaguccgcggccaucgacggggaguaccggcuccgcggcgaggcccggaagacguucgucgagcugaugcgccggggcgaccugcccguguggcucuccuacaagguggccagcgagggguuccaguacuccgaccgccgguggugcuucgacggcgagcgcaacaaccagguccuggaggagaacauggacguggagaucuggaccaaggagggggagcggaagaagcugcgcccccgguggcucgacgcccgcaccuacagcgacccgcuggcgcugcgggaguucaaggaguucgccgccggccgccgguccgugagcggcgaccucauccuggagaucgggaagcugccccagcaccucacccugcgcgcccagaacgcccuggacaaccucgucaugcugcacaacagcgagcagggcgggaaggcguaccggcacgccauggaggagcugcccgacaccaucgagacgcucaugcugcuggcccucaucgccgugcugaccggcggggugacccuguucuuccucuccggcaagggccuggggaagaccagcaucggccugcucugcgucacggcguccagcgcccugcuguggauggccuccguggagccccacuggaucgccgccagcaucauccucgaguucuuccugauggugcugcucaucccggagcccgaccgccagcggacgccccaggacaaccagcuggcguacgucgugaucgggcuccucuucaugauccugaccguggccgccaacgagaugggccugcucgagaccacgaagaaggaccuggggaucggcuacgucgccgccgagaaccaccagcacgcgaccaugcuggacguggaccuccgcccggccuccgccuggacccuguacgccguggccaccacggucaucacccccaugaugcggcacaccaucgagaacaccacggcgaacaucagccugaccgccaucgccaaccaggccgccauccucaugggccuggacaagggguggcccaucuccaagauggacaucggcgugccccugcucgcgcuggggugcuacagccaggugaacccgcugacccucaccgccgccguccugaugcugguggcccacuacgcgaucaucggccccgggcuccaggccaaggccacgcgcgaggcccagaagcgcaccgccgcgggcaucaugaagaaccccaccguggacggcaucgucgccaucgaccuggaccccgugguguacgacgccaaguucgagaagcagcuggggcagaucaugcuccugauccugugcaccucccagauccuccugaugcggacgaccugggcccugugcgagagcaucacccucgccaccggcccgcugacgacccugugggaggggucccccggcaaguucuggaacaccaccaucgcggucagcauggccaacaucuuccgcggcuccuaccucgccggggccggccuggccuucagccugaugaagucccucgggggcgggcggcgcggcacgggcgcgcagggggagacccugggcgagaaguggaagcggcagcugaaccagcucagcaaguccgaguucaacaccuacaagcgcagcgggaucauggagguggaccggagcgaggccaaggagggccugaagcgcggggagaccacgaagcacgccgugucccggggcaccgccaagcugcgcugguucgucgagcggaaccuggugaagcccgagggcaaggugaucgaccucgggugcggccgcgggggcuggagcuacuacugcgcggggcugaagaaggucaccgaggugaagggcuacaccaagggcgggcccggccacgaggagccgauccccauggccaccuacggguggaaccuggugaagcuccacuccggcaaggacgucuucuucaugccgcccgagaagugcgacacgcugcugugcgacaucggggagagcuccccgaaccccaccaucgaggagggccggacccuccgcgugcugaagaugguggagcccuggcugaagggcaaccaguucugcaucaagauccucaaccccuacaugccgagcgucguggagacccuggagcagaugcagcggaagcacgggggcaugcuggugcgcaacccccucucccggaacagcacgcacgagauguacugggucuccugcgggaccggcaacaucgugagcgccgugaacaugaccucccgcaugcugcugaaccgguucaccaugguccaccgcaagcccacguacgagcgcgacguggaccucggcgccgggacccggcacguggccgucgagcccgagguggcgaaccuggacaucaucggccagcgcaucgagaacaucaagaacgagcacaagagcaccuggcacuacgacgaggacaacccguacaagaccugggccuaccacggguccuacgaggucaagcccagcggcuccgccagcuccauggugaacggggugguccggcugcucacgaagcccugggacgugauccccauggugacccagaucgccaugaccgacaccacgccguucggccagcagcgcgucuucaaggagaagguggacacccggacgccccgcgccaagcggggcaccacgcagaucauggaggugaccgcgaaguggcuguggggguuccugagccgcaacaagaagccccggaucugcacccgcgaggaguucacccggaagguccgcuccaacgccgccaucggcgccguguucguggacgagaaccaguggaacagcgccaaggaggcggucgaggacgagcgguucugggaccucgugcaccgcgagcgggagcugcacaagcaggggaagugcgccacgugcguguacaacaugaugggcaagcgcgagaagaagcugggggaguucggcaaggccaagggcagccgggccaucugguacauguggcucggggcgcgcuuccuggaguucgaggcccugggcuucaugaacgaggaccacugguucucccgggagaacagccucuccggggucgagggcgaggggcugcacaagcugggcuacauccuccgcgacaucagcaagaucccgggcgggaacauguacgccgacgacaccgccggcugggacacccggaucaccgaggacgaccugcagaacgaggccaagaucacggacaucauggagcccgagcacgcgcugcucgccaccuccaucuucaagcugaccuaccagaacaagguggugcgcguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuuccugcccuccgagcuggagaccccgaaccucgccgagcgggugcuggacuggcuggagaagcacggcgccgagcgccucaagcggauggcgaucagcggggacgacugcgucgugaagcccaucgacgaccgcuucgccacggcccugaccgcccugaacgacaugggcaaggugcggaaggacaucccccagugggagcccuccaagggcuggaacgacuggcagcaggucccguucugcagccaccacuuccaccagcucgugaugaaggacgggcgcgagaucgugguccccugccggaaccaggacgagcuggugggccgcgcccgggugucccagggggcgggcuggagccugcgcgagaccgccugccucgggaaguccuacgcccagauguggcagcugauguacuuccaccggcgcgaccugcggcucgccgccaacgcgaucugcagcgccguccccguggacugggugcccaccucccgcaccacguggagcauccacgcccaccaccaguggaugaccaccgaggacaugcugagcgucuggaaccggguguggaucgaggagaacccguggauggaggacaagacccacguguccagcugggaggagguccccuaccugggcaagcgcgaggaccaguggugcggcucccucaucgggcugacggcccgcgcgaccugggccaccaacauccagguggccaucaaccaggugcggcgccugaucggcaacgagaacuaccucgacuacaugaccagcaugaagcgguucaagaacgaguccgaccccgagggggcccugugguga

SEQ ID NO: 8238 - RNA, 9879 nt, Artificial Sequence
  derived and/or modified CDS sequence (opt1) from DENV-1__FJ639796__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcgcccggccagcgccuggacccucuacgccguggcgaccacggugaucacccccaugaugcggcacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccggacccugcgcguccucaagaugguggagcccuggcugaagggcaaccaguucugcaucaagauccugaaccccuacaugccguccguggucgagacccucgagcagaugcagcggaagcacgggggcaugcuggugcgcaacccccugagccggaacuccacgcacgagauguacugggugagcugcgggaccggcaacaucgucuccgccgugaacaugaccagccgcaugcuccugaaccgguucaccauggcccaccgcaagcccacguacgagcgcgacguggaccugggcgcggggacccggcacgucgccguggagcccgagguggccaaccucgacaucaucggccagcgcaucgagaacaucaagaacgagcacaaguccaccuggcacuacgacgaggacaacccguacaagaccugggccuaccacgggagcuacgaggucaagcccuccggcagcgccuccagcauggugaacggggucgugcggcugcugacgaagcccugggacgugauccccauggucacccagaucgcgaugaccgacaccacgccguucggccagcagcgcguguucaaggagaagguggacacccggacgccccgcgccaagcggggcaccacgcagaucauggaggucaccgccaaguggcucuggggguuccugucccgcaacaagaagccccggaucugcacccgcgaggaguucacccggaaggugcgcagcaacgccgccaucggcgcgguguucgucgacgagaaccaguggaacagcgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccggaucaccgaggacgaccuccagaacgaggccaagaucacggacaucauggagcccgagcacgcccugcuggccaccagcaucuucaagcucaccuaccagaacaaggugguccgcgugcagcgccccgccaagaacgggaccgugauggacgucaucucccggcgcgaccagcggggcagcggccagguggggacguacggccugaacaccuucaccaacauggaggugcagcugauccgccagauggaguccgaggggaucuuccuccccagcgagcuggagaccccgaaccuggcggagcggguccucgacuggcuggagaagcacggcgccgagcgccugaagcggauggccaucuccggggacgacugcguggugaagcccaucgacgaccgcuucgccacggcccucaccgcgcugaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcccgggugagccagggggccggcuggucccugcgcgagaccgccugccugggcaagagcuacgcccagauguggcagcucauguacuuccaccggcgcgaccugcggcuggcggccaacgccaucugcuccgccguccccguggacugggugcccaccagccgcaccacguggagcauccacgcgcaccaccaguggaugaccaccgaggacaugcucuccgucuggaaccggguguggaucgaggagaacccguggauggaggacaagacccacgugagcuccugggaggagguccccuaccugggcaagcgcgaggaccaguggugcggcagccugaucgggcucacggcccgcgccaccugggccaccaacauccagguggccaucaaccaggugcggcgccugaucggcaacgagaacuaccuggacuacaugaccuccaugaagcgguucaagaacgagagcgaccccgagggggcgcucugguga

SEQ ID NO: 8239 - RNA, 9879 nt, Artificial Sequence
  derived and/or modified CDS sequence (opt1) from DENV-1__FJ639797__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggccgggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagaccugcaucuggcccaagagccacacgcucugguccaacgggguccuggagagcgagaugaucauccccaagaucuacggcgggccgaucucccagcacaacuaccggcccggcuacuucacccagaccgccgggcccuggcaccugggcaagcucgagcuggacuucgaccugugcgagggcaccacggugguggucgacgagcacugcgggaaccgcggcccgagccuccggaccaccaccgugacggggaagaucauccacgaguggugcugccgcuccugcacccugccgccccugcgguuccgcggcgaggacgggugcugguacggcauggagauccggcccgugaaggagaaggaggagaaccucguccgcagcaugguguccgccggcagcggggagguggacagcuucucccugggcauccugugcgucagcaucaugaucgaggaggugaugcggucccgcuggagccgcaagaugcucaugaccgggacccuggccguguuccugcuccugaucaugggccagcugacguggaacgaccucauccggcugugcaucauggucggggccaacgcguccgaccgcaugggcaugggcaccaccuaccuggcccucauggccaccuucaagaugcggccgauguucgccguggggcugcuguuccgccggcucacgagccgcgaggugcugcugcucaccaucggccugucccuggucgccagcguggagcuccccaacucccuggaggagcugggggacggccucgcgaugggcaucaugaugcugaagcugcucaccgaguuccagccccaccagcuguggaccacgcugcucagccugaccuucgucaagaccacccugucccucgacuacgccuggaagacgaccgccauggugcugagcaucgugucccuguucccccucugccugagcaccaccucccagaagacgaccuggcugccgguccuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcaccaugaagaucaaggacgaggagcgcgacgacacgcucaccauccugcugaaggccacccuccuggccguguccgggguguaccccaugagcauccccgcgacccuguucgucugguacuucuggcagaagaagaagcagcgguccggcgugcucugggacacgcccagcccgcccgagguggagcgcgccguccuggacgacggcaucuaccggauccugcagcgcgggcugcucggccggucccaggugggggugggcgucuuccaggacgggguguuccacaccauguggcacgugacccgcggcgccguccugauguaccagggcaagcggcuggagcccagcugggccuccgugaagaaggaccucaucagcuacgggggcggguggcgcuuccagggcuccuggaacaccggggaggaggugcaggucaucgccguggagcccggcaagaacccgaagaacgugcagacgacccccggcaccuucaagacccccgagggggaggucggcgcgaucgcccuggacuucaagcccgggacgagcggcuccccgaucgugaaccgggagggcaagaucguggggcuguacggcaacggggucgugaccaccagcggcaccuacguguccgccaucgcccaggccaaggcgagccaggaggggccccuccccgagaucgaggacgaggucuucaagaagcgcaaccugacgaucauggaccugcacccgggcagcggcaagacccggcgcuaccuccccgccaucgugcgggaggccaucaagcgcaagcugcgcacccugauccucgcccccacccggguggucgcguccgagauggccgaggcccugaaggggaugcccauccgcuaccagacgaccgccgucaagagcgagcacaccggccgggagaucguggaccugaugugccacgccaccuucacgaugcgccuccuguccccgguccgggugcccaacuacaacaugaucaucauggacgaggcgcacuucaccgaccccgccagcaucgccgcccgcggguacaucuccacccgggugggcaugggggaggccgcggccaucuucaugaccgccacgcccccgggcagcgucgaggccuucccccaguccaacgccgugauccaggacgaggagcgcgacauccccgagcggagcuggaacuccggcuacgacuggaucaccgacuuccccgggaagaccgugugguucgucccgagcaucaaguccggcaacgacaucgcgaacugccugcgcaagaacgggaagcgggugauccagcucagccgcaagaccuucgacacggaguaccagaagaccaagaacaacgacugggacuacguggucaccaccgacaucuccgagaugggcgccaacuuccgggccgaccgcgugaucgacccccggcgcugccugaagcccgugauccugaaggacgggcccgagcgggucauccucgccggcccgaugcccgugacggucgcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagaccuucguggagcucaugcggcgcggcgaccugcccgucuggcugagcuacaagguggccuccgagggguuccaguacagcgaccggcgcuggugcuucgacggcgagcggaacaaccaggugcucgaggagaacauggacgucgagaucuggacgaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcgguccucacgggcggggugacccuguucuuccugagcggcaagggccucgggaagaccuccaucggccugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccaccaagaaggaccucgggaucggcuacguggccgcggagaaccaccagcacgccacgaugcuggacgucgaccugcggccggccagcgccuggacccucuacgccguggcgaccaccgugaucacgcccaugaugcgccacaccaucgagaacaccaccgccaacaucucccugacggccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacccgcgaggcccagaagcggacggcggccggcaucaugaagaaccccaccguggacggcaucguggccaucgaccucgaccccgucguguacgacgccaaguucgagaagcagcuggggcagaucaugcugcucauccugugcaccagccagauccugcucaugcgcaccacgugggcccugugcgaguccaucacccuggcgaccggcccgcucaccacgcugugggaggggagccccggcaaguucuggaacaccaccaucgccguguccauggccaacaucuuccggggcagcuaccuggccggggccggccucgcguucucccugaugaagucccucgggggcgggcgccgggggaccggcgcccagggggagacgcucggcgagaaguggaagcgccagcugaaccagcuguccaagagcgaguucaacaccuacaagcggagcgggaucauggaggucgaccgcuccgaggccaaggagggccucaagcgcggggagaccaccaagcacgccgugagccgcggcacggcgaagcugcggugguucguggagcgcaaccuggucaagcccgagggcaaggugaucgaccuggggugcggccgcggcgggugguccuacuacugcgccgggcucaagaaggugaccgaggucaagggguacaccaagggcgggcccggccacgaggagccgauccccauggccaccuacggguggaaccuggugaagcugcacagcggcaaggacguguucuucaugccgcccgagaagugcgacacccuccugugcgacaucggggaguccagcccgaaccccacgaucgaggagggccgcacccugcggguccucaagaugguggagcccuggcugaagggcaaccaguucugcaucaagauccugaaccccuacaugccguccguggucgagacccucgagcagaugcagcgcaagcacgggggcaugcuggugcggaacccccugagccgcaacuccacccacgagauguacugggugagcugcgggacgggcaacaucgucuccgccgugaacaugaccagccggaugcuccugaaccgcuucaccauggcccaccgcaagcccaccuacgagcgggacguggaccugggcgcggggacgcgccacgucgccguggagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugaccaagcccugggacgugauccccauggucacgcagaucgcgaugaccgacaccaccccguucggccagcagcggguguucaaggagaagguggacacgcgcacgccccgggccaagcgcggcaccacccagaucauggaggucacggccaaguggcucuggggguuccugucccggaacaagaagccccgcaucugcacccgggaggaguucacccgcaaggugcggagcaacgccgccaucggcgcgguguucgucgacgagaaccaguggaacagcgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacacggcgggcugggacacccgcaucaccgaggacgaccuccagaacgaggccaagaucaccgacaucauggagcccgagcacgcccugcuggccacgagcaucuucaagcucaccuaccagaacaaggugguccgcgugcagcggcccgccaagaacgggaccgugauggacgucaucucccgccgggaccagcgcggcagcggccagguggggaccuacggccugaacacguucaccaacauggaggugcagcugauccggcagauggaguccgaggggaucuuccuccccagcgagcuggagaccccgaaccuggcggagcgcguccucgacuggcuggagaagcacggcgccgagcggcugaagcgcauggccaucuccggggacgacugcguggugaagcccaucgacgaccgguucgccaccgcccucacggcgcugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugcccaccagccggaccaccuggagcauccacgcgcaccaccaguggaugacgaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucaccgcccgggccacgugggccaccaacauccagguggccaucaaccaggugcgccggcugaucggcaacgagaacuaccuggacuacaugaccuccaugaagcgcuucaagaacgagagcgaccccgagggggcgcucugguga

SEQ ID NO: 8240 - RNA, 9879 nt, Artificial Sequence
  derived and/or modified CDS sequence (opt1) from DENV-1__FJ639802__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguaccgcuuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagaccugcaucuggcccaagagccacacgcucugguccaacgggguccuggagagcgagaugaucauccccaagaucuacggcgggccgaucucccagcacaacuaccggcccggcuacuucacccagaccgccgggcccuggcaccugggcaagcucgagcuggacuucgaccugugcgagggcaccacggugguggucgacgagcacugcgggaaccgcggcccgagccuccggaccaccaccgugacggggaagaucauccacgaguggugcugccgcuccugcacccugccgccccugcgguuccgcggcgaggacgggugcugguacggcauggagauccggcccgugaaggagaaggaggagaaccucguccgcagcaugguguccgccggcagcggggagguggacagcuucucccugggcauccugugcgucagcaucaugaucgaggaggugaugcggucccgcuggagccgcaagaugcucaugaccgggacccuggccguguuccugcuccugaucaugggccagcugacguggaacgaccucauccggcugugcaucauggucggggccaacgcguccgaccgcaugggcaugggcaccaccuaccuggcccucauggccaccuucaagaugcggccgauguucgccguggggcugcuguuccgccggcucacgagccgcgaggugcugcugcucaccaucggccugucccuggucgccagcguggagcuccccaacucccuggaggagcugggggacggccucgcgaugggcaucaugaugcugaagcugcucaccgaguuccagccccaccagcuguggaccacgcugcucagccugaccuucgucaagaccacccugucccucgacuacgccuggaagacgaccgccauggugcugagcaucgugucccuguucccccucugccugagcaccaccucccagaagacgaccuggcugccgguccuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcaccaugaagaucaaggacgaggagcgcgacgacacgcucaccauccugcugaaggccacccuccuggccguguccgggguguaccccaugagcauccccgcgacccuguucgucugguacuucuggcagaagaagaagcagcgguccggcgugcucugggacacgcccagcccgcccgagguggagcgcgccguccuggacgacggcaucuaccggauccugcagcgcgggcugcucggccggucccaggugggggugggcgucuuccaggacgggguguuccacaccauguggcacgugacccgcggcgccguccugauguaccagggcaagcggcuggagcccagcugggccuccgugaagaaggaccucaucagcuacgggggcggguggcgcuuccagggcuccuggaacaccggggaggaggugcaggucaucgccguggagcccggcaagaacccgaagaacgugcagacgacccccggcaccuucaagacccccgagggggaggucggcgcgaucgcccuggacuucaagcccgggacgagcggcuccccgaucgugaaccgggagggcaagaucguggggcuguacggcaacggggucgugaccaccagcggcaccuacguguccgccaucgcccaggccaaggcgagccaggaggggccccuccccgagaucgaggacgaggucuucaagaagcgcaaccugacgaucauggaccugcacccgggcagcggcaagacccggcgcuaccuccccgccaucgugcgggaggccaucaagcgcaagcugcgcacccugauccucgcccccacccggguggucgcguccgagauggccgaggcccugaaggggaugcccauccgcuaccagacgaccgccgucaagagcgagcacaccggccgggagaucguggaccugaugugccacgccaccuucacgaugcgccuccuguccccgguccgggugcccaacuacaacaugaucaucauggacgaggcgcacuucaccgaccccgccagcaucgccgcccgcggguacaucuccacccgggugggcaugggggaggccgcggccaucuucaugaccgccacgcccccgggcagcgucgaggccuucccccaguccaacgccgugauccaggacgaggagcgcgacauccccgagcggagcuggaacuccggcuacgacuggaucaccgacuuccccgggaagaccgugugguucgucccgagcaucaaguccggcaacgacaucgcgaacugccugcgcaagaacgggaagcgggugauccagcucagccgcaagaccuucgacacggaguaccagaagaccaagaacaacgacugggacuacguggucaccaccgacaucuccgagaugggcgccaacuuccgggccgaccgcgugaucgacccccggcgcugccugaagcccgugauccugaaggacgggcccgagcgggucauccucgccggcccgaugcccgugacggucgcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagaccuucguggagcucaugcggcgcggcgaccugcccgucuggcugagcuacaagguggccuccgagggguuccaguacagcgaccggcgcuggugcuucgacggcgagcggaacaaccaggugcucgaggagaacauggacgucgagaucuggacgaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcgguccucacgggcggggugacccuguucuuccugagcggcaagggccucgggaagaccuccaucggccugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccaccaagaaggaccucgggaucggcuacguggccgcggagaaccaccagcacgccacgaugcuggacgucgaccugcggccggccagcgccuggacccucuacgccguggcgaccaccgugaucacgcccaugaugcgccacaccaucgagaacaccaccgccaacaucucccugacggccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacccgcgaggcccagaagcggacggcggccggcaucaugaagaaccccaccguggacggcaucguggccaucgaccucgaccccgucguguacgacgccaaguucgagaagcagcuggggcagaucaugcugcucauccugugcaccagccagauccugcucaugcgcaccacgugggcccugugcgaguccaucacccuggcgaccggcccgcucaccacgcugugggaggggagccccggcaaguucuggaacaccaccaucgccguguccauggccaacaucuuccggggcagcuaccuggccggggccggccucgcguucucccugaugaagucccucgggggcgggcgccgggggaccggcgcccagggggagacgcucggcgagaaguggaagcgccagcugaaccagcuguccaagagcgaguucaacaccuacaagcggagcgggaucauggaggucgaccgcuccgaggccaaggagggccucaagcgcggggagaccaccaagcacgccgugagccgcggcacggcgaagcugcggugguucguggagcgcaaccuggucaagcccgagggcaaggugaucgaccuggggugcggccgcggcgggugguccuacuacugcgccgggcucaagaaggugaccgaggucaagggguacaccaagggcgggcccggccacgaggagccgauccccauggccaccuacggguggaaccuggugaagcugcacagcggcaaggacguguucuucaugccgcccgagaagugcgacacccuccugugcgacaucggggaguccagcccgaaccccacgaucgaggagggccgcacccugcggguccucaagaugguggagcccuggcugaagggcaaccaguucugcaucaagauccugaaccccuacaugccguccguggucgagacccucgagcagaugcagcgcaagcacgggggcaugcuggugcggaacccccugagccgcaacuccacccacgagauguacugggugagcugcgggacgggcaacaucgucuccgccgugaacaugaccagccggaugcuccugaaccgcuucaccauggcccaccgcaagcccaccuacgagcgggacguggaccugggcgcggggacgcgccacgucgccguggagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugaccaagcccugggacgugauccccauggucacgcagaucgcgaugaccgacaccaccccguucggccagcagcggguguucaaggagaagguggacacgcgcacgccccgggccaagcgcggcaccacccagaucauggaggucacggccaaguggcucuggggguuccugucccggaacaagaagccccgcaucugcacccgggaggaguucacccgcaaggugcggagcaacgccgccaucggcgcgguguucgucgacgagaaccaguggaacagcgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacacggcgggcugggacacccgcaucaccgaggacgaccuccagaacgaggccaagaucaccgacaucauggagcccgagcacgcccugcuggccacgagcaucuucaagcucaccuaccagaacaaggugguccgcgugcagcggcccgccaagaacgggaccgugauggacgucaucucccgccgggaccagcgcggcagcggccagguggggaccuacggccugaacacguucaccaacauggaggugcagcugauccggcagauggaguccgaggggaucuuccuccccagcgagcuggagaccccgaaccuggcggagcgcguccucgacuggcuggagaagcacggcgccgagcggcugaagcgcauggccaucuccggggacgacugcguggugaagcccaucgacgaccgguucgccaccgcccucacggcgcugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugcccaccagccggaccaccuggagcauccacgcgcaccaccaguggaugacgaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucaccgcccgggccacgugggccaccaacauccagguggccaucaaccaggugcgccggcugaucggcaacgagaacuaccuggacuacaugaccuccaugaagcgcuucaagaacgagagcgaccccgagggggcgcucugguga

SEQ ID NO: 8241 - RNA, 9879 nt, Artificial Sequence
  derived and/or modified CDS sequence (opt1) from DENV-1__JN819410__SS-prME
agcgugaccaugcugcucaugcugcugcccaccgcccucgccuuccaccugaccacccggggcggggagccccacaugaucgucagcaagcaggagcggggcaagagccugcuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcacccugguggaccggggcugggggaacggcugcggccucuucggcaaggggaaccugcugacgugcgccaaguucaagugcgugaccaagcucgagggcaagaucguccaguacgagaaccugaaguacagcgugaucgugaccguccacaccggcgaccagcaccagguggggaacgagacgaccgagcacggcaccaucgcgaccaucacgccccaggcccccacguccgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcccacgcgaagaagcaggaggucguggugcugggcagccaggagggcgccaugcacaccgcccucaccggggccacggagauccagaccuccggcaccaccacgaucuucgccgggcaccugaagugccgccugaagauggacaagcucacccugaagggcaugagcuacgucaugugcaccggguccuucaagcuggagaaggagguggcggagacccagcacggcacggugcugguccaggugaaguacgagggcaccgacgcccccugcaagauccccuucagcacccaggacgagaagggggugacccagaacggccggcucaucacggccaacccgaucgucaccgacaaggagaagcccgugaacaucgagaccgagccgcccuucggggaguccuacaucguggucggcgccggcgagaaggcgcugaagcugagcugguucaagcgcggguccagcaucggcaagauguucgaggccaccgcccgcggggcccgccgcauggccauccucggcgacacggcgugggacuucggguccaucggcggcguguucaccagcguggggaagcugguccaccagguguucggcaccgccuacggggugcuguucuccggcgucagcuggaccaugaagaucgggaucggcauccuccugacguggcugggccucaacucccggagcaccucccugagcaugaccugcaucgccguggggauggugacccuguaccucggcgucauggugcaggccgacuccgggugcgugaucaacuggaagggccgcgagcugaagugcgggagcggcaucuucgucacgaacgaggugcacaccuggaccgagcaguacaaguuccaggccgacuccccgaagcggcugagcgcggccaucggcaaggccugggaggagggggugugcggcauccgcagcgccacccggcucgagaacaucauguggaagcagaucuccaacgagcugaaccacauccugcucgagaacgacaugaaguucaccgucguggugggggacgccaacggcauccuggcgcaggggaagaagaugauccgcccccagcccauggagcacaaguacagcuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcuccgcgacagcuacacccagaugugcgaccaccggcugauguccgcggccaucaaggacagcaaggccgugcacgccgacaugggcuacuggaucgaguccgagaagaacgagaccuggaagcuggcccgcgcgagcuucaucgaggucaagaccugcacguggcccaagucccacacccucuggagcaacggggugcuggaguccgagaugaucauccccaagaucuacggcgggccgaucagccagcacaacuaccggcccggcuacuucacccagaccgccgggcccuggcaccugggcaagcucgagcuggacuucgaccugugcgagggcacgaccguggucguggacgagcacugcgggaaccgcggcccgucccuccggaccaccacggugaccgggaagaucauccacgaguggugcugccgcagcugcacccugccgccccugcgguuccgcggcgaggacgggugcugguacggcauggagauccggcccgucaaggagaaggaggagaaccucgugcgcuccauggugagcgccggcuccggggaggucgacagcuucagccugggcauccugugcguguccaucaugaucgaggaggugaugcggagccgcuggucccgcaagaugcucaugaccgggacgcuggccgucuuccugcuccugaucaugggccagcugaccuggaacgaccucauccggcugugcaucauggugggggccaacgcgagcgaccgcaugggcaugggcaccaccuaccuggcccucauggccacguucaagaugcggccgauguucgccguggggcugcuguuccgccggcucaccucccgcgagguccugcugcucaccaucggccugagccugguggccuccgucgagcuccccaacagccuggaggagcugggggacggccucgcgaugggcaucaugaugcugaagcugcucaccgaguuccagccccaccagcuguggacgacccugcucucccugaccuucaucaagaccacgcugagccucgacuacgccuggaagaccaccgccauggugcuguccaucgugagccuguucccccucugccuguccaccacgagccagaagaccaccuggcugccgguccuccugggguccuucggcugcaagccccugaccauguuccucaucaccgagaacaagaucugggggcgcaagagcuggccccugaacgagggcaucauggccaucgggaucguguccauccugcucagcucccugcugaagaacgacgugccccucgcgggcccgcugaucgccggcgggaugcugaucgccugcuacgucaucagcggcagcuccgccgaccucagccuggagaaggccgcggagguguccugggagcaggaggccgagcacagcggggccucccacaacauccugguggagguccaggacgacggcacgaugaagaucaaggacgaggagcgcgacgacacccucaccauccugcugaaggccacccuccuggccgugagcgggguguaccccauguccauccccgcgacgcuguucgucugguacuucuggcagaagaagaagcagcggagcggcgugcucugggacacccccuccccgcccgagguggagcgcgccguccuggacgacggcaucuaccggauccugcagcgcgggcugcucggccggagccaggugggggugggcgucuuccaggacgggguguuccacaccauguggcacgugacccgcggcgccguccugauguaccagggcaagcggcuggagcccuccugggccagcgugaagaaggaccucaucuccuacgggggcggguggcgcuuccagggcagcuggaacacgggggaggaggugcaggucaucgccguggagcccggcaagaacccgaagaacgugcagaccacccccggcaccuucaagacgcccgagggggaggucggcgcgaucgcccuggacuucaagcccgggaccuccggcagcccgaucgugaaccgggagggcaagaucguggggcuguacggcaacggggucgugaccaccuccggcacguacgugagcgccaucgcccaggccaaggcgucccaggaggggccccuccccgagaucgaggacgaggucuucaagaagcgcaaccugaccaucauggaccugcacccgggcagcggcaagacccggcgcuaccuccccgccaucgugcgggaggccaucaagcgcaagcugcgcacccugauccucgcccccacgcggguggucgcgagcgagauggccgaggcccugaaggggaugcccauccgcuaccagaccaccgccgugaaguccgagcacaccggccgggagaucguggaccugaugugccacgccacguucaccaugcgccuccugagcccgguccgggugcccaacuacaacaugaucaucauggacgaggcgcacuucaccgaccccgccuccaucgccgcccgcggguacaucagcacccgggugggcaugggggaggccgcggccaucuucaugacggccacgccgcccggcuccgucgaggccuucccccagagcaacgccgugauccaggacgaggagcgcgacauccccgagcgguccuggaacagcggcuacgacuggaucaccgacuuccccgggaagaccgugugguucguccccuccaucaagagcggcaacgacaucgcgaacugccugcgcaagaacgggaagcgggugauccagcucucccgcaagacguucgacaccgaguaccagaagaccaagaacaacgacugggacuacguggucaccacggacaucagcgagaugggcgccaacuuccgggccgaccgcgugaucgacccccggcgcugccugaagcccgugauccugaaggacgggcccgagcgggucauccucgccggcccgaugcccgugaccgucgcguccgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucguggagcucaugcggcgcggcgaccugcccgucuggcuguccuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcgcggaccuacagcgacccgcucgcccugcgcgaguucaaggaguucgccgccggccggcgcuccgugagcggcgaccugauccucgagaucgggaagcugccccagcaccugacccuccgggcccagaacgcgcuggacaaccuggugaugcuccacaacagcgagcagggcgggaaggccuaccgccacgccauggaggagcugcccgacaccaucgagacgcugaugcuccuggcccugaucgcgguccucaccggcggggugacccuguucuuccuguccggcaagggccucgggaagaccagcaucggccugcugugcgugacggccuccagcgcccuccuguggauggccuccgucgagccccacuggaucgccgcgagcaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcacccggccuccgccuggacccucuacgccguggcgaccacggugaucacccccaugaugcggcacaccaucgagaacaccacggccaacaucagccugaccgccaucgccaaccaggccgcgauccugaugggccucgacaagggguggcccaucuccaagauggacaucggcgucccccugcuggcccucgggugcuacagccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccucccagauccugcucaugcggacgaccugggcccugugcgagagcaucacccuggcgaccggcccgcucacgacccugugggaggggucccccggcaaguucuggaacaccaccaucgccgugagcauggccaacaucuuccgcggcuccuaccuggccggggccggccucgcguucagccugaugaagucccucgggggcgggcggcgcgggacgggcgcccagggggagacccucggcgagaaguggaagcggcagcugaaccagcugagcaaguccgaguucaacaccuacaagcgcagcgggaucauggaggucgaccggagcgaggccaaggagggccucaagcgcggggagaccacgaagcacgccgugucccggggcaccgcgaagcugcgcugguucguggagcggaaccuggucaagcccgagggcaaggugaucgaccuggggugcggccgcgggggcuggagcuacuacugcgccgggcucaagaaggugaccgaggucaagggcuacaccaagggcgggcccggccacgaggagccgauccccauggccaccuacggguggaaccuggugaagcugcacuccggcaaggacguguucuucaugccgcccgagaagugcgacacgcuccugugcgacaucggggagagcuccccgaaccccaccaucgaggagggccggacccugcgcguccucaagaugguggagcccuggcugcggggcaaccaguucugcaucaagauccugaaccccuacaugccgagcguggucgagacccucgagcagaugcagcgcaagcacgggggcaugcuggugcggaacccccugucccgcaacagcacgcacgagauguacuggguguccugcgggaccggcaacaucgucagcgccgugaacaugaccucccggaugcuccugaaccgcuucaccauggcccaccgcaagcccacguacgagcgggacguggaccugggcgcggggacccgccacgucgccguggagcccgagguggccaaccucgacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggucgugcgccugcugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgccaaguggcucuggggguuccugagccggaacaagaagccccgcaucugcacccgggaggaguucacccgcaaggugcgguccaacgccgccaucggcgcgguguucgucgacgagaaccaguggaacagcgccaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggcgaagggcagccgcgccaucugguacauguggcugggggcccgguuccucgaguucgaggcccugggcuucaugaacgaggaccacugguucucccgcgagaacagccuguccgggguggagggcgaggggcuccacaagcugggcuacauccugcgggacaucagcaagaucccgggcgggaacauguacgccgacgacaccgcgggcugggacacccgcaucaccgaggacgaccuccagaacgaggccaagaucacggacaucauggagcccgagcacgcccugcuggccaccuccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggugcagcugauccggcagauggagagcgaggggaucuuccuccccuccgagcuggagaccccgaaccuggcggagcgcgcccucgacuggcuggagaagcacggcgccgagcggcugaagcgcauggccaucagcggggacgacugcgucgugaagcccaucgacgaccgguucgccacggcgcucaccgcccugaacgacaugggcaaggugcgcaaggacaucccccagugggagcccuccaagggcuggaacgacuggcagcaggucccguucugcagccaccacuuccaccagcugaucaugaaggacgggcgggagaucguggugcccugccgcaaccaggacgagcucgucggccgggcccgcgugucccagggggccggcuggagccugcgggagaccgccugccuggggaaguccuacgcgcagauguggcagcucauguacuuccaccgccgggaccugcgccuggccgccaacgccaucugcagcgcggugcccgucgacugggugcccaccucccggaccacguggagcauccacgcccaccaccaguggaugaccaccgaggacaugcucagcguguggaaccgcgucuggaucgaggagaacccguggauggaggacaagacccacguguccagcugggaggaggugcccuaccugggcaagcgcgaggaccaguggugcggcucccugaucgggcucacggcccgggccaccugggccaccaacauccaggucgcgaucaaccaggugcgccggcugaucggcaacgagaacuaccuggacuacaugaccagcaugaagcgcuucaagaacgaguccgaccccgagggggcccucugguga

SEQ ID NO: 8242 - RNA, 9879 nt, Artificial Sequence
  derived and/or modified CDS sequence (opt1) from DENV-1__FJ639806__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggccgggccugggaggagggggugugcggcauccgcuccgccacccggcucgagaacaucauguggaagcagaucagcaacgagcugaaccacauccugcucgagaacgacaugaaguucaccgucguggugggggacgccaacggcauccuggcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcaucuucaccacgaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagaccugcaucuggcccaagagccacacgcucugguccaacgggguccuggagagcgagaugaucauccccaagaucuacggcgggccgaucucccagcacaacuaccggcccggcuacuucacccagaccgccgggcccuggcaccugggcaagcucgagcuggacuucgaccugugcgagggcaccacggugguggucgacgagcacugcgggaaccgcggcccgagccuccggaccaccaccgugacggggaagaucauccacgaguggugcugccgcuccugcacccugccgccccugcgguuccgcggcgaggacgggugcugguacggcauggagauccggcccgugaaggagaaggaggagaaccucguccgcagcaugguguccgccggcagcggggagguggacagcuucucccugggcauccugugcgucagcaucaugaucgaggaggugaugcggucccgcuggagccgcaagaugcucaugaccgggacccuggccguguuccugcuccugaucaugggccagcugacguggaacgaccucauccggcugugcaucauggucggggccaacgcguccgaccgcaugggcaugggcaccaccuaccuggcccucauggccaccuucaagaugcggccgauguucgccguggggcugcuguuccgccggcucacgagccgcgaggugcugcugcucaccaucggccugucccuggucgccagcguggagcuccccaacucccuggaggagcugggggacggccucgcgaugggcaucaugaugcugaagcugcucaccgaguuccagccccaccagcuguggaccacgcugcucagccugaccuucgucaagaccacccugucccucgacuacgccuggaagacgaccgccauggugcugagcaucgugucccuguucccccucugccugagcaccaccucccagaagacgaccuggcugccgguccuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcaccaugaagaucaaggacgaggagcgcgacgacacgcucaccauccugcugaaggccacccuccuggccguguccgggguguaccccaugagcauccccgcgacccuguucgucugguacuucuggcagaagaagaagcagcgguccggcgugcucugggacacgcccagcccgcccgagguggagcgcgccguccuggacgacggcaucuaccggauccugcagcgcgggcugcucggccggucccaggugggggugggcgucuuccaggacgggguguuccacaccauguggcacgugacccgcggcgccguccugauguaccagggcaagcggcuggagcccagcugggccuccgugaagaaggaccucaucagcuacgggggcggguggcgcuuccagggcuccuggaacaccggggaggaggugcaggucaucgccguggagcccggcaagaacccgaagaacgugcagacgacccccggcaccuucaagacccccgagggggaggucggcgcgaucgcccuggacuucaagcccgggacgagcggcuccccgaucgugaaccgggagggcaagaucguggggcuguacggcaacggggucgugaccaccagcggcaccuacguguccgccaucgcccaggccaaggcgagccaggaggggccccuccccgagaucgaggacgaggucuucaagaagcgcaaccugacgaucauggaccugcacccgggcagcggcaagacccggcgcuaccuccccgccaucgugcgggaggccaucaagcgcaagcugcgcacccugauccucgcccccacccggguggucgcguccgagauggccgaggcccugaaggggaugcccauccgcuaccagacgaccgccgucaagagcgagcacaccggccgggagaucguggaccugaugugccacgccaccuucacgaugcgccuccuguccccgguccgggugcccaacuacaacaugaucaucauggacgaggcgcacuucaccgaccccgccagcaucgccgcccgcggguacaucuccacccgggugggcaugggggaggccgcggccaucuucaugaccgccacgcccccgggcagcgucgaggccuucccccaguccaacgccgugauccaggacgaggagcgcgacauccccgagcggagcuggaacuccggcuacgacuggaucaccgacuuccccgggaagaccgugugguucgucccgagcaucaaguccggcaacgacaucgcgaacugccugcgcaagaacgggaagcgggugauccagcucagccgcaagaccuucgacacggaguaccagaagaccaagaacaacgacugggacuacguggucaccaccgacaucuccgagaugggcgccaacuuccgggccgaccgcgugaucgacccccggcgcugccugaagcccgugauccugaaggacgggcccgagcgggucauccucgccggcccgaugcccgugacggucgcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagaccuucguggagcucaugcggcgcggcgaccugcccgucuggcugagcuacaagguggccuccgagggguuccaguacagcgaccggcgcuggugcuucgacggcgagcggaacaaccaggugcucgaggagaacauggacgucgagaucuggacgaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacccugaugcuccuggcccugaucgcgguccucacgggcggggugacccuguucuuccugagcggcaagggccucgggaagaccuccaucggccugcugugcgugaccgccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccaccaagaaggaccucgggaucggcuacguggccgcggagaaccaccagcacgccacgaugcuggacgucgaccugcggccggccagcgccuggacccucuacgccguggcgaccaccgugaucacgcccaugaugcgccacaccaucgagaacaccaccgccaacaucucccugacggccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacccgcgaggcccagaagcggacggcggccggcaucaugaagaaccccaccguggacggcaucguggccaucgaccucgaccccgucguguacgacgccaaguucgagaagcagcuggggcagaucaugcugcucauccugugcaccagccagauccugcucaugcgcaccacgugggcccugugcgaguccaucacccuggcgaccggcccgcucaccacgcugugggaggggagccccggcaaguucuggaacaccaccaucgccguguccauggccaacaucuuccggggcagcuaccuggccggggccggccucgcguucucccugaugaagucccucgggggcgggcgccgggggaccggcgcccagggggagacgcucggcgagaaguggaagcgccagcugaaccagcuguccaagagcgaguucaacaccuacaagcggagcgggaucauggaggucgaccgcuccgaggccaaggagggccucaagcgcggggagaccaccaagcacgccgugagccgcggcacggcgaagcugcggugguucguggagcgcaaccuggucaagcccgagggcaaggugaucgaccuggggugcggccgcggcgggugguccuacuacugcgccgggcucaagaaggugaccgaggucaagggguacaccaagggcgggcccggccacgaggagccgauccccauggccaccuacggguggaaccuggugaagcugcacagcggcaaggacguguucuucaugccgcccgagaagugcgacacccuccugugcgacaucggggaguccagcccgaaccccacgaucgaggagggccgcacccugcggguccucaagaugguggagcccuggcugaagggcaaccaguucugcaucaagauccugaaccccuacaugccguccguggucgagacccucgagcagaugcagcgcaagcacgggggcaugcuggugcggaacccccugagccgcaacuccacccacgagauguacugggugagcugcgggacgggcaacaucgucuccgccgugaacaugaccagccggaugcuccugaaccgcuucaccauggcccaccgcaagcccaccuacgagcgggacguggaccugggcgcggggacgcgccacgucgccguggagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugaccaagcccugggacgugauccccauggucacgcagaucgcgaugaccgacaccaccccguucggccagcagcggguguucaaggagaagguggacacgcgcacgccccgggccaagcgcggcaccacccagaucauggaggucacggccaaguggcucuggggguuccugucccggaacaagaagccccgcaucugcacccgggaggaguucacccgcaaggugcggagcaacgccgccaucggcgcgguguucgucgacgagaaccaguggaacagcgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacacggcgggcugggacacccgcaucaccgaggacgaccuccagaacgaggccaagaucaccgacaucauggagcccgagcacgcccugcuggccacgagcaucuucaagcucaccuaccagaacaaggugguccgcgugcagcggcccgccaagaacgggaccgugauggacgucaucucccgccgggaccagcgcggcagcggccagguggggaccuacggccugaacacguucaccaacauggaggugcagcugauccggcagauggaguccgaggggaucuuccuccccagcgagcuggagaccccgaaccuggcggagcgcguccucgacuggcugaagaagcacggcgccgagcggcugaagcgcauggccaucuccggggacgacugcguggugaagcccaucgacgaccgguucgccaccgcccucacggcgcugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugcccaccagccggaccaccuggagcauccacgcgcaccaccaguggaugacgaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucaccgcccgggccacgugggccaccaacauccagguggccaucaaccaggugcgccggcugaucggcaacgagaacuaccuggacuacaugaccuccaugaagcgcuucaagaacgagagcgaccccgagggggcgcucugguga

SEQ ID NO: 8243 - RNA, 9879 nt, Artificial Sequence
  derived and/or modified CDS sequence (opt1) from DENV-1__JN819411__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucgucggccagcugaccuggaacgaccucauccgccugugcaucauggugggggccaacgcguccgaccggaugggcaugggcaccaccuaccuggcccucauggccacguucaagaugcgcccgauguucgccguggggcugcuguuccggcgccucaccagccgggagguccugcugcucaccaucgggcugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgcgacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccuccccgagaucgaggacgagguguucaagaagcggaaccugaccaucauggaccugcacccgggcagcggcaagacccgccgguaccuccccgccaucgugcgcgaggccaucaagcggaagcugcgcacccugauccucgcccccacgcgcgucguggcguccgagauggccgaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgccggcccgaugcccgucaccguggcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggucaugcuccacaacuccgagcagggcgggaaggccuaccggcacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgccgcggagaaccaccagcacgccaccaugcuggacguggaccugcgcccggccagcgccuggacccucuacgccguggcgaccacggucaucacccccaugaugcggcacaccaucgagaacaccacggccaacaucucccugaccgccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacgcgcgaggcccagaagcgcaccgcggccggcaucaugaagaaccccaccguggacggcaucgucgccaucgaccucgaccccgugguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccgucuccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgugagccggggcaccgcgaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccggugcccauggccaccuacggguggaaccuggucaagcugcacagcggcaaggacguguucuucaugccgcccgagaagugcgacacgcuccugugcgacaucggggaguccagcccgaaccccaccaucgaggagggccggacccugcgcgugcucaagauggucgagcccuggcugaagggcaaccaguucugcaucaagauccugaaccccuacaugccguccgugguggagacccucgagcagaugcagcggaagcacgggggcaugcugguccgcaacccccugagccggaacuccacgcacgagauguacugggugagcugcgggaccggcaacaucguguccgccgucaacaugaccagccgcaugcuccugaaccgguucaccauggcccaccgcaagcccacguacgagcgcgacguggaccugggcgcggggacccggcacguggccgucgagcccgagguggccaaccucgacaucaucggccagcgcaucgagaacaucaagaacgagcacaagcugaccuggcacuacgacgaggacaacccguacaagaccugggccuaccacggguccuacgaggucaagcccagcggcuccgccagcuccauggugaacggggugguccggcugcucacgaagcccugggacgugauccccauggugacccagaucgcgaugaccgacaccacgccguucggccagcagcgcgucuucaaggagaagguggacacccggacgccccgcgccaagcggggcaccacgcagaucauggaggugaccgccaaguggcuguggggguuccugagccgcaacaagaagccccggaucugcacccgcgaggaguucacccggaagguccgcuccaacgccgccaucggcgcgguguucguggacgagaaccaguggaacagcgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggcgaagggcagccgggccaucugguacauguggcucggggcccgcuuccuggaguucgaggcccugggcuucaugaacgaggaccacugguucucccgggagaacagccucuccggggucgagggcgaggggcugcacaagcugggcuacauccuccgcgacaucagcaagaucccgggcgggaacauguacgccgacgacaccgcgggcugggacacccggaucaccgaggacgaccugcagaacgaggccaagaucacggacaucauggagcccgagcacgcccugcucgccaccuccaucuucaagcugaccuaccagaacaagguggugcgcguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuucucccccagcgagcuggagaccccgaaccuggcggagcgggugcucgacuggcuggagaagcacggcgccgagcgccugaagcggauggccaucuccggggacgacugcgucgugaagcccaucgacgaccgcuucgccacggcccucaccgcgcugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcccagauguggcagcucauguacuuccaccggcgcgaccugcggcuggcggccaacgccaucugcuccgccgugcccgucgacugggugcccaccagccgcaccacguggagcauccacgcgcaccaccaguggaugaccaccgaggacaugcucuccguguggaaccgggucuggaucgaggagaacccguggauggaggacaagacccacgugagcuccugggaggaggugcccuaccugggcaagcgcgaggaccaguggugcggcagccugaucgggcucacggcccgcgccaccugggccaccaacauccaggucgccaucaaccaggugcggcgccugaucggcaacgagaacuaccuggacuacaugaccuccaugaagcgguucaagaacgagagcgaccccgagggggcgcucugguga

SEQ ID NO: 8244 - RNA, 9879 nt, Artificial Sequence
  derived and/or modified CDS sequence (opt1) from DENV-1__FJ639812__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugaugcuccugacgaugaaggagaaguccuggcugguccacaagcagugguuccucgaccugccgcugcccuggaccuccggggccagcaccagccaggagaccuggaaccggcaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggaggucgcggagacccagcacggcacggugcuggugcaggucaaguacgagggcaccgacgcccccugcaagauccccuucuccacccaggacgagaagggggugacccagaacggccggcucaucacggccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcgucuucaccuccguggggaagcuggugcaccaggucuucggcaccgccuacggggugcuguucagcggcguguccuggaccaugaagaucgggaucggcauccuccugacguggcugggccucaacagccgcuccaccagccuguccaugaccugcaucgccgucgggauggugacccuguaccucggcgugaugguccaggccgacagcgggugcgugaucaacuggaagggccgggagcugaagugcggguccggcaucuucgugacgaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccguggucgugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggagguggaggacuacggguucggcaucuucaccacgaacaucuggcugaagcuccgggacuccuacacccagaugugcgaccaccgccugaugagcgcggccaucaaggacuccaaggccguccacgccgacaugggcuacuggaucgagagcgagaagaacgagaccuggaagcuggcccgggcguccuucaucgaggugaagaccugcacguggcccaagagccacacccucugguccaacggggugcuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgucgugguggacgagcacugcgggaaccggggcccgagccuccgcaccaccacggucaccgggaagaucauccacgaguggugcugccgguccugcacccugccgccccugcgcuuccggggcgaggacgggugcugguacggcauggagauccgccccgugaaggagaaggaggagaaccucgugcggagcauggucuccgccggcagcggggagguggacagcuucucccugggcauccugugcgugagcaucaugaucgaggaggucaugcgcucccgguggagccgcaagaugcucaugaccgggacgcuggccguguuccugcuccugaucaugggccagcugaccuggaacgaccucauccgccugugcaucauggugggggccaacgcguccgaccggaugggcaugggcaccaccuaccuggcccucauggccacguucaagaugcgcccgauguucgccgucgggcugcuguuccggcgccucaccagccgggaggugcugcugcucaccaucgggcugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccaugguccugagcaucgugucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgucagcauccugcucuccagccugcugaagaacgacgugccccucgcgggcccgcugaucgccggcgggaugcugaucgccugcuacgugaucagcggcuccagcgccgaccuccugcuggagaaggccgcggaggucuccugggagcaggaggccgagcacagcggggccucccacaacauccucguggaggugcaggacgacggcacgaugaagaucaaggacgaggagcgggacgacacccugaccauccugcucaaggccacccugcuggccgucagcgggguguaccccauguccauccccgcgacccucuucgugugguacuucuggcagaagaagaagcagcgcagcggcguccugugggacacccccuccccgcccgagguggagcgggccgugcuggacgacggcaucuaccgcauccugcagcgggggcuccugggccgcagccaggucggggugggcguguuccaggacggggucuuccacaccauguggcacgugacccggggcgccgugcugauguaccagggcaagcgccucgagcccuccugggccagcgucaagaaggaccugaucuccuacgggggcggguggcgguuccagggcagcuggaacacgggggaggagguccaggugaucgccgucgagcccggcaagaacccgaagaacgugcagaccacccccggcaccuucaagacgcccgagggggaggugggcgcgaucgcccuggacuucaagcccgggaccuccggcagcccgaucgucaaccgcgagggcaagaucguggggcucuacggcaacgggguggucaccaccuccggcacguacgugagcgccaucgcccaggccaaggcgucccaggaggggccccugcccgagaucgaggacgagguguucaagaagcggaaccugaccaucauggaccuccacccgggcagcggcaagacccgccgguaccugcccgccaucguccgcgaggccaucaagcggaagcugcgcacccucauccuggcccccacgcgcgugguggcgagcgagauggccgaggcccugaaggggaugcccauccgguaccagaccaccgccgucaaguccgagcacaccggccgcgagaucguggaccucaugugccacgccacguucaccaugcggcugcugagcccggugcgcguccccaacuacaacaugaucaucauggacgaggcgcacuucaccgaccccgccuccaucgccgcccggggguacaucagcacccgcgugggcaugggggaggccgcggccaucuucaugacggccacgccgcccggcuccguggaggccuucccccagagcaacgccgucauccaggacgaggagcgggacauccccgagcgcuccuggaacagcggcuacgacuggaucaccgacuuccccgggaagaccgugugguucgugcccuccaucaagagcggcaacgacaucgcgaacugccuccggaagaacgggaagcgcgucauccagcugucccggaagacguucgacaccgaguaccagaagaccaagaacaacgacugggacuacguggugaccacggacaucagcgagaugggcgccaacuuccgcgccgaccgggucaucgacccccgccggugccugaagcccgugauccucaaggacgggcccgagcgcgugauccuggccggcccgaugcccgucaccguggcguccgccgcccagcggcgcggccggaucgggcgcaaccagaacaaggagggcgaccaguacgucuacauggggcagccccugaacaacgacgaggaccacgcccacuggaccgaggccaagaugcuccuggacaacaucaacacccccgagggcaucaucccggcgcuguucgagcccgagcgcgagaaguccgccgccaucgacggggaguaccggcuccgcggcgaggcccggaagacguucguggagcugaugcgccggggcgaccugcccguguggcucuccuacaaggucgccagcgagggguuccaguacuccgaccgccgguggugcuucgacggcgagcgcaacaaccaggugcuggaggagaacauggacguggagaucuggaccaaggagggggagcggaagaagcugcgcccccgguggcucgacgcgcgcaccuacagcgacccgcuggcccugcgggaguucaaggaguucgccgccggccgccgguccgucagcggcgaccucauccuggagaucgggaagcugccccagcaccucacccugcgcgcccagaacgcgcuggacaaccucgugaugcugcacaacagcgagcagggcgggaaggccuaccggcacgccauggaggagcugcccgacaccaucgagacgcucaugcugcuggcccucaucgcggugcugaccggcggggucacccuguucuuccucuccggcaagggccuggggaagaccagcaucggccugcucugcgugacggccuccagcgcccugcuguggauggccuccguggagccccacuggaucgccgcgagcaucauccucgaguucuuccugaugguccugcucaucccggagcccgaccgccagcggacgccccaggacaaccagcuggccuacguggugaucgggcuccucuucaugauccugaccgucgccgccaacgagaugggccugcucgagaccacgaagaaggaccuggggaucggcuacguggccgcggagaaccaccagcacgccaccaugcuggacguggaccuccgcccggccuccgccuggacccuguacgccgucgcgaccacggugaucacccccaugaugcggcacaccaucgagaacaccacggccaacaucagccugaccgccaucgccaaccaggccgcgauccucaugggccuggacaagggguggcccaucuccaagauggacaucggcgugccccugcucgcccuggggugcuacagccaggucaacccgcugacccucaccgccgccgugcugaugcugguggcgcacuacgccaucaucggccccgggcuccaggccaaggccacgcgcgaggcccagaagcgcaccgcggccggcaucaugaagaaccccaccgucgacggcaucguggccaucgaccuggaccccguggucuacgacgccaaguucgagaagcagcuggggcagaucaugcuccugauccugugcaccucccagauccuccugaugcggacgaccugggcccugugcgagagcaucacccucgcgaccggcccgcugacgacccugugggaggggucccccggcaaguucuggaacaccaccaucgccgugagcauggccaacaucuuccgcggcuccuaccucgccggggccggccuggcguucagccugaugaagucccucgggggcgggcggcgcggcacgggcgcccagggggagacccugggcgagaaguggaagcggcagcugaaccagcucagcaaguccgaguucaacaccuacaagcgcagcgggaucauggagguggaccggagcgaggccaaggagggccugaagcgcggggagaccacgaagcacgccgucucccggggcaccgcgaagcugcgcugguucguggagcggaaccuggugaagcccgagggcaaggucaucgaccucgggugcggccgcgggggcuggagcuacuacugcgccgggcugaagaaggugaccgaggugaagggcuacaccaagggcgggcccggccacgaggagccgauccccauggccaccuacggguggaaccuggucaagcuccacuccggcaaggacguguucuucaugccgcccgagaagugcgacacgcugcugugcgacaucggggagagcuccccgaaccccaccaucgaggagggccggacccuccgcgugcugaagauggucgagcccuggcugaagggcaaccaguucugcaucaagauccucaaccccuacaugccgagcgugguggagacccuggagcagaugcagcggaagcacgggggcaugcugguccgcaacccccucucccggaacagcacgcacgagauguacuggguguccugcgggaccggcaacaucgugagcgccgucaacaugaccucccgcaugcugcugaaccgguucaccauggcccaccgcaagcccacguacgagcgcgacguggaccucggcgcggggacccggcacguggccgucgagcccgagguggccaaccuggacaucaucggccagcgcaucgagaacaucaagaacgagcacaagagcaccuggcacuacgacgaggacaacccguacaagaccugggccuaccacggguccuacgaggugaagcccagcggcuccgccagcuccauggucaacggggugguccggcugcucacgaagcccugggacgugauccccauggugacccagaucgcgaugaccgacaccacgccguucggccagcagcgcgucuucaaggagaagguggacacccggacgccccgcgccaagcggggcaccacgcagaucauggaggugaccgccaaguggcuguggggguuccugagccgcaacaagaagccccggaucugcacccgcgaggaguucacccggaagguccgcuccaacgccgccaucggcgcgguguucguggacgagaaccaguggaacagcgccaaggaggccgucgaggacgagcgguucugggaccucgugcaccgcgagcgggagcugcacaagcaggggaagugcgccacgugcguguacaacaugaugggcaagcgcgagaagaagcugggggaguucggcaaggcgaagggcagccgggccaucugguacauguggcucggggcccgcuuccuggaguucgaggcccugggcuucaugaacgaggaccacugguucucccgggagaacagccucuccggggucgagggcgaggggcugcacaagcugggcuacauccuccgcgacaucagcaagaucccgggcgggaacauguacgccgacgacaccgcgggcugggacacccggaucaccgaggacgaccugcagaacgaggccaagaucacggacaucauggagcccgagcacgcccugcucgccaccuccaucuucaagcugaccuaccagaacaagguggugcgcguccagcgccccgccaagaacgggaccgugauggacgugaucagccggcgcgaccagcggggcuccggccaggucgggacguacggccugaacaccuucaccaacauggaggugcagcucauccgccagauggagagcgaggggaucuuccugcccuccgagcuggagaccccgaaccucgcggagcgggugcuggacuggcuggagaagcacggcgccgagcgccucaagcggauggccaucagcggggacgacugcgucgugaagcccaucgacgaccgcuucgccacggcccugaccgcgcugaacgacaugggcaaggugcggaaggacaucccccagugggagcccuccaagggcuggaacgacuggcagcaggucccguucugcagccaccacuuccaccagcucaucaugaaggacgggcgcgagaucguggugcccugccggaaccaggacgagcuggucggccgcgcccgggugucccagggggccggcuggagccugcgcgagaccgccugccucgggaaguccuacgcccagauguggcagcugauguacuuccaccggcgcgaccugcggcucgcggccaacgccaucugcagcgccgugcccgucgacugggugcccaccucccgcaccacguggagcauccacgcgcaccaccaguggaugaccaccgaggacaugcugagcguguggaaccgggucuggaucgaggagaacccguggauggaggacaagacccacguguccagcugggaggaggugcccuaccugggcaagcgcgaggaccaguggugcggcucccucaucgggcugacggcccgcgccaccugggccaccaacauccaggucgccaucaaccaggugcggcgccugaucggcaacgagaacuaccucgacuacaugaccagcaugaagcgguucaagaacgaguccgaccccgagggggcgcugugguga

SEQ ID NO: 8245 - RNA, 9879 nt, Artificial Sequence
  derived and/or modified CDS sequence (opt1) from DENV-1__FJ639813__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaugaaccccgcggugcuccggaagcugugcaucgaggccaagaucagcaacaccaccaccgacucccgcugccccacgcagggcgaggccacccugguggaggagcaggacgccaacuucgucugccggcgcaccuucguggaccggggcugggggaacggcugcggccucuucggcaaggggagccugcugaccugcgccaaguucaagugcgugacgaagcucgagggcaagaucguccaguacgagaaccugaaguacuccgugaucgugaccguccacaccggcgaccagcaccagguggggaacgagaccacggagcacggcaccaucgcgaccaucacgccccaggcccccaccagcgagauccagcugacggacuacggggcccucacccuggacugcagcccccgcaccggccuggacuucaacgagaugguccuccugaccaugaaggagaaguccuggcuggugcacaagcagugguuccucgaccugccgcugcccuggacguccggggccagcaccagccaggagaccuggaaccggcaggaccuccuggugaccuucaagacggcccacgcgaagaagcaggaggucguggugcugggcucccaggagggcgccaugcacaccgcccucaccggggccaccgagauccagacgagcggcaccaccaccaucuucgccgggcaccugaagugccgccugaagauggacaagcucacgcugaagggcauguccuacgucaugugcaccgggagcuucaagcuggagaaggagguggcggagacccagcacggcaccgugcugguccaggugaaguacgagggcacggacgcccccugcaagauccccuucuccacccaggacgagaagggggugacccagaacggccggcucaucaccgccaacccgaucgucacggacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagcuucuccaugaccugcaucgccguggggauggugacccuguaccugggcgucauggugcaggccgacagcgggugcgugaucaacuggaagggccgggagcucaagugcggguccggcaucuucgucaccaacgaggugcacacguggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacaccacguucaucaucgacgggcccgacaccccggagugccccgacggccagcgcgccuggaacaucugggaggucgaggacuacggguucggcaucuucaccaccaacaucuggcugaagcugcgggacuccuacacgcagaugugcgaccaccgccucaugagcgcggccaucaaggacuccaaggccgugcacgccgacaugggcuacuggaucgagagcgagaagaacgagaccuggaagcuggcccgggcguccuucaucgaggugaagaccugcaccuggcccaagagccacacgcugugguccaacgggguccucgagagcgagaugaucauccccaagaucuacggcgggccgaucucccagcacaacuaccgccccggcuacuucacccagaccgccgggcccuggcaccugggcaagcuggagcucgacuucgaccugugcgagggcaccacggugguggucgacgagcacugcgggaaccggggcccgagccugcgcaccaccaccgugacggggaagaucauccacgaguggugcugccgguccugcacccugccgccccugcgcuuccggggcgaggacgggugcugguacggcauggagauccgccccgugaaggagaaggaggagaaccugguccggagcaugguguccgccggcagcggggagguggacagcuucucccucggcauccugugcgucagcaucaugaucgaggaggugaugcgcucccgguggagccgcaagaugcugaugaccgggacccucgccguguuccugcugcucaucaugggccagcugacguggaacgaccugauccgccucugcaucauggucggggccaacgcguccgaccggaugggcaugggcaccaccuaccuggcccugauggccaccuucaagaugcgcccgauguucgccguggggcuccuguuccggcgccugacgagccgggaggugcuccugcugaccaucgggcucucccuggucgccagcguggagcugcccaacucccucgaggagcugggggacggccuggcgaugggcaucaugaugcucaagcugcugaccgaguuccagccccaccagcucuggaccacgcugcugagccucaccuucgucaagaccacccugucccuggacuacgccuggaagacgaccgccauggugcucagcaucgugucccuguucccccugugccucagcaccaccucccagaagacgaccuggcugccgguccugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgugccccuggcgggcccgcucaucgccggcgggaugcugaucgccugcuacgucaucagcggcuccagcgccgaccugucccucgagaaggccgcggaggugagcugggagcaggaggccgagcacuccggggccagccacaacauccugguggagguccaggacgacggcaccaugaagaucaaggacgaggagcgggacgacacgcugaccauccuccugaaggccacccugcucgccguguccgggguguaccccaugagcauccccgcgacccuguucgucugguacuucuggcagaagaagaagcagcgcuccggcgugcugugggacacgcccagcccgcccgagguggagcgggccguccucgacgacggcaucuaccgcauccugcagcgggggcugcugggccgcucccaggugggggugggcgucuuccaggacgggguguuccacaccauguggcacgugacccggggcgccguccucauguaccagggcaagcgccuggagcccagcugggccuccgugaagaaggaccugaucagcuacgggggcggguggcgguuccagggcuccuggaacaccggggaggaggugcaggucaucgccguggagcccggcaagaacccgaagaacgugcagacgacccccggcaccuucaagacccccgagggggaggucggcgcgaucgcccucgacuucaagcccgggacgagcggcuccccgaucgugaaccgcgagggcaagaucguggggcuguacggcaacggggucgugaccaccagcggcaccuacguguccgccaucgcccaggccaaggcgagccaggaggggccccugcccgagaucgaggacgaggucuucaagaagcggaaccucacgaucauggaccugcacccgggcagcggcaagacccgccgguaccugcccgccaucgugcgcgaggccaucaagcggaagcuccgcacccugauccuggcccccacccgcguggucgcguccgagauggccgaggcccucaaggggaugcccauccgguaccagacgaccgccgucaagagcgagcacaccggccgcgagaucguggaccugaugugccacgccaccuucacgaugcggcugcucuccccgguccgcgugcccaacuacaacaugaucaucauggacgaggcgcacuucaccgaccccgccagcaucgccgcccggggguacaucuccacccgcgugggcaugggggaggccgcggccaucuucaugaccgccacgcccccgggcagcgucgaggccuucccccaguccaacgccgugauccaggacgaggagcgggacauccccgagcgcagcuggaacuccggcuacgacuggaucaccgacuuccccgggaagaccgugugguucgucccgagcaucaaguccggcaacgacaucgcgaacugccugcggaagaacgggaagcgcgugauccagcugagccggaagaccuucgacacggaguaccagaagaccaagaacaacgacugggacuacguggucaccaccgacaucuccgagaugggcgccaacuuccgcgccgaccgggugaucgacccccgccggugccucaagcccgugauccugaaggacgggcccgagcgcgucauccuggccggcccgaugcccgugacggucgcgagcgccgcccagcggcgcggccggaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagaccuucguggagcugaugcgccggggcgaccuccccgucuggcugagcuacaagguggccuccgagggguuccaguacagcgaccgccgguggugcuucgacggcgagcgcaacaaccaggugcuggaggagaacauggacgucgagaucuggacgaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggugaugcugcacaacuccgagcagggcgggaaggccuaccggcacgccauggaggagcuccccgacaccaucgagacccugaugcugcucgcccugaucgcgguccugacgggcggggugacccucuucuuccugagcggcaagggccuggggaagaccuccaucggccuccugugcgugaccgccagcuccgcccugcucuggauggccagcgucgagccccacuggaucgccgcguccaucauccuggaguucuuccugauggugcuccugaucccggagcccgaccgccagcggacgccccaggacaaccagcuggccuacguggucaucgggcuccuguucaugauccugaccguggccgccaacgagaugggccuccuggagaccaccaagaaggaccuggggaucggcuacguggccgcggagaaccaccagcacgccacgaugcucgacgucgaccugcgcccggccagcgccuggacccuguacgccguggcgaccaccgugaucacgcccaugaugcggcacaccaucgagaacaccaccgccaacaucucccucacggccaucgccaaccaggccgcgauccugaugggccuggacaagggguggcccaucagcaagauggacaucggcgucccccuccuggcccuggggugcuacucccaggugaacccgcucacccugaccgccgccgugcugaugcucgucgcgcacuacgccaucaucggccccgggcugcaggccaaggccacccgcgaggcccagaagcgcacggcggccggcaucaugaagaaccccaccguggacggcaucguggccaucgaccuggaccccgucguguacgacgccaaguucgagaagcagcucgggcagaucaugcugcugauccucugcaccagccagauccugcugaugcggaccacgugggcccucugcgaguccaucacccuggcgaccggcccgcugaccacgcucugggaggggagccccggcaaguucuggaacaccaccaucgccguguccauggccaacaucuuccgcggcagcuaccuggccggggccggccuggcguucucccucaugaagucccucgggggcgggcggcgcgggaccggcgcccagggggagacgcugggcgagaaguggaagcggcagcucaaccagcuguccaagagcgaguucaacaccuacaagcgcagcgggaucauggaggucgaccgguccgaggccaaggagggccugaagcgcggggagaccaccaagcacgccgugagccggggcacggcgaagcuccgcugguucguggagcggaaccuggucaagcccgagggcaaggugaucgaccuggggugcggccgcgggggcugguccuacuacugcgccgggcugaagaaggugaccgaggucaagggcuacaccaagggcgggcccggccacgaggagccgaugcccauggccaccuacggguggaaccucgugaagcugcacagcggcaaggacguguucuucaugccgcccgagaagugcgacacccugcucugcgacaucggggaguccagcccgaaccccacgaucgaggagggccggacccugcgcguccugaagaugguggagcccuggcucaagggcaaccaguucugcaucaagauccugaaccccuacaugccguccguggucgagacccuggagcagaugcagcggaagcacgggggcaugcucgugcgcaacccccugagccggaacuccacccacgagauguacugggugagcugcgggacgggcaacaucgucuccgccgugaacaugaccagccgcaugcugcucaaccgguucaccauggcccaccgcaagcccaccuacgagcgcgacguggaccugggcgcggggacgcggcacgucgccguggagcccgagguggccaaccuggacaucaucggccagcgcaucgagaacaucaagaacgagcacaaguccaccuggcacuacgacgaggacaacccguacaagaccugggccuaccacgggagcuacgaggucaagcccuccggcagcgccuccagcauggugaacggggucgugcggcuccugaccaagcccugggacgugauccccauggucacgcagaucgcgaugaccgacaccaccccguucggccagcagcgcguguucaaggagaagguggacacgcggacgccccgcgccaagcggggcaccacccagaucauggaggucacggccaaguggcuguggggguuccucucccgcaacaagaagccccggaucugcacccgcgaggaguucacccggaaggugcgcagcaacagcgccaucggcgccguguucgucgacgagaaccaguggaacuccgcgaaggaggccguggaggacgagcgguucugggaccuggugcaccgcgagcgggagcugcacaagcaggggaagugcgcgaccugcgucuacaacaugaugggcaagcgcgagaagaagcucggggaguucggcaaggccaagggcagccgggcgaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgccgacgacacggccggcugggacacccggaucaccgaggacgaccugcagaacgaggcgaagaucaccgacaucauggagcccgagcacgcccuccuggccacguccaucuucaagcugaccuaccagaacaaggugguccgcgugcagcgccccgccaagaacgggaccgugauggacgucaucagccggcgcgaccagcggggcuccggccagguggggaccuacggccucaacacguucaccaacauggaggugcagcugauccgccagauggagagcgaggggaucuucucccccagcgagcuggagaccccgaaccucgccgagcggguccuggacuggcuggagaagcacggcgcggagcgccucaagcggauggccaucuccggggacgacugcguggugaagcccaucgacgaccgcuucgccaccgcccugacggcccugaacgacaugggcaagguccggaaggacaucccccagugggagcccagcaagggcuggaacgacuggcagcaggucccguucugcucccaccacuuccaccagcucaucaugaaggacgggcgcgagaucgugguccccugccggaaccaggacgagcuggugggccgcgcgcgggugagccagggggccggcuggucccugcgcgagaccgccugccucggcaagagcuacgcccagauguggcagcugauguacuuccaccggcgcgaccugcggcucgccgcgaacgccaucugcagcgccguccccguggacugggugcccaccucccgcaccaccuggagcauccacgcccaccaccaguggaugacgaccgaggacaugcuguccgucuggaaccggguguggaucgaggagaacccguggauggaggacaagacccacgugagcuccugggaggagguccccuaccugggcaagcgcgaggaccaguggugcggcagccucaucgggcugaccgcgcgcgccacgugggccaccaacauccagguggccaucaaccaggugcggcgccugaucggcaacgagaacuaccucgacuacaugaccuccaugaagcgguucaagaacgagagcgaccccgagggggcccugugguga

SEQ ID NO: 8246 - RNA, 9879 nt, Artificial Sequence
  derived and/or modified CDS sequence (opt1) from DENV-1__JN819412__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccuccugcuggagaaggccgcggagguguccugggagcaggaggccgagcacagcggggccucccacaacauccucguggagguccaggacgacggcacgaugaagaucaaggacgaggagcgggacgacacccugaccauccugcucaaggccacccugcuggccgugagcgggguguaccccauguccauccccgcgacccucuucgucugguacuucuggcagaagaagaagcagcgcagcggcgugcugugggacacccccuccccgcccgagguggagcgggccguccuggacgacggcaucuaccgcauccugcagcgggggcuccugggccgcagccaggugggggugggcgucuuccaggacgggguguuccacaccauguggcacgugacccggggcgccguccugauguaccagggcaagcgccucgagcccuccugggccagcgugaagaaggaccugaucuccuacgggggcggguggcgguuccagggcagcuggaacacgggggaggaggugcaggucaucgccguggagcccggcaagaacccgaagaacgugcagaccacccccggcaccuucaagacgcccgagggggaggucggcgcgaucgcccuggacuucaagcccgggaccuccggcagcccgaucgugaaccgcgagggcaagaucguggggcucuacggcaacggggucgugaccaccuccggcacguacgugagcgccaucgcccaggccaaggcgucccaggaggggccccugcccgagaucgaggacgaggucuucaagaagcggaaccugaccaucauggaccuccacccgggcagcggcaagacccgccgguaccugcccgccaucgugcgcgaggccaucaagcggaagcugcgcacccucauccuggcccccacgcgcguggucgcgagcgagauggccgaggcccugaaggggaugcccauccgguaccagaccaccgccgugaaguccgagcacaccggccgcgagaucguggaccucaugugccacgccacguucaccaugcggcugcugagcccgguccgcgugcccaacuacaacaugaucaucauggacgaggcgcacuucaccgaccccgccuccaucgccgcccggggguacaucagcacccgcgugggcaugggggaggccgcggccaucuucaugacggccacgccgcccggcuccgucgaggccuucccccagagcaacgccgugauccaggacgaggagcgggacauccccgagcgcuccuggaacagcggcuacgacuggaucaccgacuuccccgggaagaccgugugguucguccccuccaucaagagcggcaacgacaucgcgaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccucaaggacgggcccgagcgcgucauccuggccggcccgaugcccgugaccgucgcguccgccgcccagcggcgcggccggaucgggcgcaaccagaacaaggagggcgaccaguacguguacauggggcagccccugaacaacgacgaggaccacgcccacuggaccgaggccaagaugcuccuggacaacaucaacacccccgagggcaucaucccggcgcuguucgagcccgagcgcgagaaguccgccgccaucgacggggaguaccggcuccgcggcgaggcccggaagacguucguggagcugaugcgccggggcgaccugcccgucuggcucuccuacaagguggccagcgagggguuccaguacuccgaccgccgguggugcuucgacggcgagcgcaacaaccaggugcuggaggagaacauggacgucgagaucuggaccaaggagggggagcggaagaagcugcgcccccgguggcucgacgcgcgcaccuacagcgacccgcuggcccugcgggaguucaaggaguucgccgccggccgccgguccgugagcggcgaccucauccuggagaucgggaagcugccccagcaccucacccugcgcgcccagaacgcgcuggacaaccucgugaugcugcacaacagcgagcagggcgggaaggccuaccggcacgccauggaggagcugcccgacaccaucgagacgcucaugcugcuggcccucaucgcgguccugaccggcggggugacccuguucuuccucuccggcaagggccuggggaagaccagcaucggccugcucugcgugacggccuccagcgcccugcuguggauggccuccgucgagccccacuggaucgccgcgagcaucauccucgaguucuuccugauggugcugcucaucccggagcccgaccgccagcggacgccccaggacaaccagcuggccuacguggucaucgggcuccucuucaugauccugaccguggccgccaacgagaugggccugcucgagaccacgaagaaggaccuggggaucggcuacguggccgcggagaaccaccagcacgccaccaugcuggacgucgaccuccgcccggccuccgccuggacccuguacgccguggcgaccacggugaucacccccaugaugcggcacaccaucgagaacaccacggccaacaucagccugaccgccaucgccaaccaggccgcgauccucaugggccuggacaagggguggcccaucuccaagauggacaucggcgucccccugcucgcccuggggugcuacagccaggugaacccgcugacccucaccgccgccgugcugaugcuggucgcgcacuacgccaucaucggccccgggcuccaggccaaggccacgcgcgaggcccagaagcgcaccgcggccggcaucaugaagaaccccaccguggacggcaucguggccaucgaccuggaccccgucguguacgacgccaaguucgagaagcagcuggggcagaucaugcuccugauccugugcaccucccagauccuccugaugcggacgaccugggcccugugcgagagcaucacccucgcgaccggcccgcugacgacccugugggaggggucccccggcaaguucuggaacaccaccaucgccgugagcauggccaacaucuuccgcggcuccuaccucgccggggccggccuggcguucagccugaugaagucccucgggggcgggcggcgcggcacgggcgcccagggggagacccugggcgagaaguggaagcggcagcugaaccagcucagcaaguccgaguucaacaccuacaagcgcagcgggaucauggaggucgaccggagcgaggccaaggagggccugaagcgcggggagaccacgaagcacgccgugucccggggcaccgcgaagcugcgcugguucguggagcggaaccuggucaagcccgagggcaaggugaucgaccucgggugcggccgcgggggcuggagcuacuacugcgccgggcugaagaaggugaccgaggucaagggcuacaccaagggcgggcccggccacgaggagccgauccccauggccaccuacggguggaaccuggugaagcuccacuccggcaaggacguguucuucaugccgcccgagaagugcgacacgcugcugugcgacaucggggagagcuccccgaaccccaccaucgaggagggccggacccuccgcguccugaagaugguggagcccuggcugaagggcaaccaguucugcaucaagauccucaaccccuacaugccgagcguggucgagacccuggagcagaugcagcggaagcacgggggcaugcuggugcgcaacccccucucccggaacagcacgcacgagauguacuggguguccugcgggaccggcaacaucgucagcgccgugaacaugaccucccgcaugcugcugaaccgguucaccauggcccaccgcaagcccacguacgagcgcgacguggaccucggcgcggggacccggcacgucgccguggagcccgagguggccaaccuggacaucaucggccagcgcaucgagaacaucaagaacgagcacaagagcaccuggcacuacgacgaggacaacccguacaagaccugggccuaccacggguccuacgaggucaagcccagcggcuccgccagcuccauggugaacggggucgugcggcugcucacgaagcccugggacgugauccccauggucacccagaucgcgaugaccgacaccacgccguucggccagcagcgcguguucaaggagaagguggacacccggacgccccgcgccaagcggggcaccacgcagaucauggaggucaccgccaaguggcuguggggguuccugagccgcaacaagaagccccggaucugcacccgcgaggaguucacccggaaggugcgcuccaacgccgccaucggcgcgguguucgucgacgagaaccaguggaacagcgccaaggaggccguggaggacgagcgguucugggaccucgugcaccgcgagcgggagcugcacaagcaggggaagugcgccacgugcgucuacaacaugaugggcaagcgcgagaagaagcugggggaguucggcaaggcgaagggcagccgggccaucugguacauguggcucggggcccgcuuccuggaguucgaggcccugggcuucaugaacgaggaccacugguucucccgggagaacagccucuccgggguggagggcgaggggcugcacaagcugggcuacauccuccgcgacaucagcaagaucccgggcgggaacauguacgccgacgacaccgcgggcugggacacccggaucaccgaggacgaccugcagaacgaggccaagaucacggacaucauggagcccgagcacgcccugcucgccaccuccaucuucaagcugaccuaccagaacaaggugguccgcgugcagcgccccgccaagaacgggaccgugauggacgucaucagccggcgcgaccagcggggcuccggccagguggggacguacggccugaacaccuucaccaacauggaggugcagcucauccgccagauggagagcgaggggaucuuccugcccuccgagcuggagaccccgaaccucgcggagcggguccuggacuggcuggagaagcacggcgccgagcgccucaagcggauggccaucagcggggacgacugcguggugaagcccaucgacgaccgcuucgccacggcccugaccgcgcugaacgacaugggcaagguccggaaggacaucccccagugggagcccuccaagggcuggaacgacuggcagcaggucccguucugcagccaccacuuccaccagcucaucaugaaggacgggcgcgagaucgugguccccugccggaaccaggacgagcuggugggccgcgcccgggugucccagggggccggcuggagccugcgcgagaccgccugccucgggaaguccuacgcccagauguggcagcugauguacuuccaccggcgcgaccugcggcucgcggccaacgccaucugcagcgccguccccguggacugggugcccaccucccgcaccacguggagcauccacgcgcaccaccaguggaugaccaccgaggacaugcugagcgucuggaaccggguguggaucgaggagaacccguggauggaggacaagacccacguguccagcugggaggagguccccuaccugggcaagcgcgaggaccaguggugcggcucccucaucgggcugacggcccgcgccaccugggccaccaacauccagguggccaucaaccaggugcggcgccugaucggcaacgagaacuaccucgacuacaugaccagcaugaagcgguucaagaacgaguccgaccccgagggggcgcugugguga

SEQ ID NO: 8247 - RNA, 9879 nt, Artificial Sequence
  derived and/or modified CDS sequence (opt1) from DENV-1__FJ810415__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcggguggagaccugggcccugcgccaccccggguucacggugaucgccuucuuccuggcgcacgccaucggcaccagcaucacccagaagggggugaucuucauccuccugaugcuggucacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgcggugcugcggaagcucugcaucgaggccaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgcgaccaucacgccccaggcccccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgcgaagaagcaggagguggugguccugggcucccaggagggcgccaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcgcucaagcugaacugguucaagcgcggguccagcaucggcaagauguucgaggccaccgcccgcggggcgcgccgcauggccauccugggcgacacggcgugggacuucggguccaucggcggcguguucaccagcgucgggaagcucgugcaccagguguucggcaccgccuacgggguccuguucuccggcgugagcuggaccaugaagaucgggaucggcauccugcucacguggcugggccugaacucccggagcaccucccucagcaugaccugcaucgccguggggauggucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacuccccgaagcggcugagcgcggccaucggcaaggccugggaggagggggucugcggcauccgcagcgccacccggcuggagaacaucauguggaagcagaucuccaacgagcucaaccacauccugcuggagaacgacaugaaguucaccgugguggucggggacgccaacggcauccucgcgcaggggaagaagaugauccgcccccagcccauggagcacaaguacagcuggaaguccuggggcaaggccaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacagcuacacccagaugugcgaccaccggcucauguccgcggccaucaaggacagcaaggccguccacgccgacaugggcuacuggaucgaguccgagaagaacgagaccuggaagcuggcccgcgcgagcuucaucgaggugaagaccugcacguggcccaagucccacacccuguggagcaacggggugcucgaguccgagaugaucauccccaagaucuacggcgggccgaucagccagcacaacuaccggcccggcuacuucacccagaccgccgggcccuggcaccugggcaagcuggagcucgacuucgaccugugcgagggcacgaccgucgugguggacgagcacugcgggaaccgcggcccgucccugcggaccaccacggucaccgggaagaucauccacgaguggugcugccgcagcugcacccugccgccccugcgguuccgcggcgaggacgggugcugguacggcauggagauccggcccgugaaggagaaggaggagaaccuggugcgcuccauggucagcgccggcuccggggagguggacagcuucagccucggcauccugugcguguccaucaugaucgaggaggucaugcggagccgcuggucccgcaagaugcugaugaccgggacgcucgccguguuccugcugcucaucaugggccagcugaccuggaacgaccugauccggcucugcaucauggugggggccaacgcgagcgaccgcaugggcaugggcaccaccuaccuggcccugauggccacguucaagaugcggccgauguucgccgucgggcuccuguuccgccggcugaccucccgcgaggugcuccugcugaccaucggccucagccuggucgccuccguggagcugcccaacagccucgaggagcugggggacggccuggcgaugggcaucaugaugcucaagcugcugaccgaguuccagccccaccagcucuggacgacccugcugucccucaccuucgugaagaccacgcugagccuggacuacgccuggaagaccaccgccaugguccucuccaucgugagccuguucccccugugccucuccaccacgagccagaagaccaccuggcugccggugcugcucggguccuucggcugcaagccccugaccauguuccugaucaccgagaacaagaucugggggcgcaagagcuggccccucaacgagggcaucauggccaucgggaucgucuccauccugcugagcucccuccugaagaacgacgugccccuggcgggcccgcucaucgccggcgggaugcugaucgccugcuacgugaucagcggcagcuccgccgaccugagccucgagaaggccgcggaggucuccugggagcaggaggccgagcacagcggggccucccacaacauccugguggaggugcaggacgacggcacgaugaagaucaaggacgaggagcgcgacgacacccugaccauccuccugaaggccacccugcucgccgucagcgggguguaccccauguccauccccgcgacgcuguucgugugguacuucuggcagaagaagaagcagcggagcggcguccugugggacacccccuccccgcccgagguggagcgcgccgugcucgacgacggcaucuaccggauccugcagcgcgggcugcugggccggagccaggucggggugggcguguuccaggacggggucuuccacaccauguggcacgugacccgcggcgccgugcucauguaccagggcaagcggcuggagcccuccugggccagcgucaagaaggaccugaucuccuacgggggcggguggcgcuuccagggcagcuggaacacgggggaggagguccaggugaucgccgucgagcccggcaagaacccgaagaacgugcagaccacccccggcaccuucaagacgcccgagggggaggugggcgcgaucgcccucgacuucaagcccgggaccuccggcagcccgaucgucaaccgggagggcaagaucguggggcuguacggcaacgggguggucaccaccuccggcacguacgugagcgccaucgcccaggccaaggcgucccaggaggggccccugcccgagaucgaggacgagguguucaagaagcgcaaccucaccaucauggaccugcacccgggcagcggcaagacccggcgcuaccugcccgccaucguccgggaggccaucaagcgcaagcuccgcacccugauccuggcccccacgcgggugguggcgagcgagauggccgaggcccucaaggggaugcccauccgcuaccagaccaccgccgucaaguccgagcacaccggccgggagaucguggaccugaugugccacgccacguucaccaugcgccugcucagcccggugcggguccccaacuacaacaugaucaucauggacgaggcgcacuucaccgaccccgccuccaucgccgcccgcggguacaucagcacccgggugggcaugggggaggccgcggccaucuucaugacggccacgccgcccggcuccguggaggccuucccccagagcaacgccgucauccaggacgaggagcgcgacauccccgagcgguccuggaacagcggcuacgacuggaucaccgacuuccccgggaagaccgugugguucgugcccuccaucaagagcggcaacgacaucgcgaacugccugcgcaagaacgggaagcgggucauccagcugucccgcaagacguucgacaccgaguaccagaagaccaagaacaacgacugggacuacguggugaccacggacaucagcgagaugggcgccaacuuccgggccgaccgcgucaucgacccccggcgcugccucaagcccgugauccugaaggacgggcccgagcgggucauccuggccggcccgaugcccgugaccguggcguccgccgcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucguggagcugaugcggcgcggcgaccuccccguguggcuguccuacaaggucgccagcgagggguuccaguacuccgaccggcgcuggugcuucgacggcgagcggaacaaccaggugcuggaggagaacauggacguggagaucuggaccaaggagggggagcgcaagaagcuccggccccgcuggcuggacgcgcggaccuacagcgacccgcuggcccuccgcgaguucaaggaguucgccgccggccggcgcuccgucagcggcgaccugauccuggagaucgggaagcucccccagcaccugacccugcgggcccagaacgcgcucgacaaccuggugaugcugcacaacagcgagcagggcgggaaggccuaccgccacgccauggaggagcuccccgacaccaucgagacgcugaugcugcucgcccugaucgcggugcugaccggcggggucacccucuucuuccuguccggcaagggccuggggaagaccagcaucggccuccugugcgugacggccuccagcgcccugcucuggauggccuccguggagccccacuggaucgccgcgagcaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagaccacgaagaaggaccuggggaucggcuacguggccgcggagaaccaccagcacgccaccaugcucgacguggaccugcacccggccuccgccuggacccuguacgccgucgcgaccacggugaucacccccaugaugcggcacaccaucgagaacaccacggccaacaucagccucaccgccaucgccaaccaggccgcgauccugaugggccuggacaagggguggcccaucuccaagauggacaucggcgugccccuccuggcccuggggugcuacagccaggucaacccgcucacccugaccgccgccgugcugaugcucguggcgcacuacgccaucaucggccccgggcugcaggccaaggccacgcgcgaggcccagaagcgcaccgcggccggcaucaugaagaaccccaccgucgacggcaucguggccaucgaccuggaccccguggucuacgacgccaaguucgagaagcagcucgggcagaucaugcugcugauccucugcaccucccagauccugcugaugcggacgaccugggcccucugcgagagcaucacccuggcgaccggcccgcugacgacccucugggaggggucccccggcaaguucuggaacaccaccaucgccgugagcauggccaacaucuuccgcggcuccuaccuggccggggccggccuggcguucagccucaugaagucccucgggggcgggcggcgcggcacgggcgcccagggggagacccugggcgagaaguggaagcggcagcucaaccagcugagcaaguccgaguucaacaccuacaagcgcagcgggaucauggagguggaccggagcgaggccaaggagggccugaagcgcggggagaccacgaagcacgccgucucccggggcaccgcgaagcuccgcugguucguggagcggaaccuggugaagcccgagggcaaggucaucgaccuggggugcggccgcgggggcuggagcuacuacugcgccgggcugaagaaggugaccgaggugaagggcuacaccaagggcgggcccggccacgaggagccgauccccauggccaccuacggguggaaccucgucaagcugcacuccggcaaggacguguucuucaugccgcccgagaagugcgacacgcugcucugcgacaucggggagagcuccccgaaccccaccaucgaggagggccggacccugcgcgugcugaagauggucgagcccuggcuccggggcaaccaguucugcaucaagauccugaaccccuacaugccgagcgugguggagacccuggagcagaugcagcgcaagcacgggggcaugcucguccggaacccccugucccgcaacagcacgcacgagauguacuggguguccugcgggaccggcaacaucgugagcgccgucaacaugaccucccggaugcugcucaaccgcuucaccauggcccaccgcaagcccacguacgagcgggacguggaccugggcgcggggacccgccacguggccgucgagcccgagguggccaaccuggacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggugguccgccuccugacgaagcccugggacgugauccccauggugacccagaucgcgaugaccgacaccacgccguucggccagcagcgggucuucaaggagaagguggacacccgcacgccccgggccaagcgcggcaccacgcagaucauggaggugaccgccaaguggcuguggggguuccucagccggaacaagaagccccgcaucugcacccgggaggaguucacccgcaagguccgguccaacgccgccaucggcgcgguguucguggacgagaaccaguggaacagcgccaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggcgaagggcagccgcgccaucugguacauguggcugggggcccgguuccuggaguucgaggcccucggcuucaugaacgaggaccacugguucucccgcgagaacagccuguccggggucgagggcgaggggcugcacaagcucggcuacauccugcgggacaucagcaagaucccgggcgggaacauguacgccgacgacaccgcgggcugggacacccgcaucaccgaggacgaccugcagaacgaggccaagaucacggacaucauggagcccgagcacgcccuccuggccaccuccaucuucaagcugaccuaccagaacaagguggugcgcguccagcggcccgccaagaacgggaccgugauggacgugaucagccgccgggaccagcgcggcuccggccaggucgggacguacggccucaacaccuucaccaacauggaggugcagcugauccggcagauggagagcgaggggaucuuccugcccuccgagcucgagaccccgaaccuggcggagcgcgcccuggacuggcucgagaagcacggcgccgagcggcugaagcgcauggccaucagcggggacgacugcguggucaagcccaucgacgaccgguucgccacggcgcugaccgcccucaacgacaugggcaaggugcgcaaggacaucccccagugggagcccuccaagggcuggaacgacuggcagcaggucccguucugcagccaccacuuccaccagcugaucaugaaggacgggcgggagaucgucgugcccugccgcaaccaggacgagcuggugggccgggcccgcgucucccagggggccggcuggagccuccgggagaccgccugccuggggaaguccuacgcgcagauguggcagcugauguacuuccaccgccgggaccuccgccuggccgccaacgccaucugcagcgcggugcccguggacuggguccccaccucccggaccacguggagcauccacgcccaccaccaguggaugaccaccgaggacaugcugagcguguggaaccgcguguggaucgaggagaacccguggauggaggacaagacccacgucuccagcugggaggaggugcccuaccucggcaagcgcgaggaccaguggugcggcucccugaucgggcugacggcccgggccaccugggccaccaacauccagguggcgaucaaccagguccgccggcucaucggcaacgagaacuaccuggacuacaugaccagcaugaagcgcuucaagaacgaguccgaccccgagggggcccugugguga

SEQ ID NO: 8248 - RNA, 9879 nt, Artificial Sequence
  derived and/or modified CDS sequence (opt1) from DENV-1__FJ639814__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucaaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgcgacgcuguucgugugguacuucuggcagaagaagaagcagcgguccggcgugcugugggacacccccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgcgaucgcccucgacuucaagcccgggaccagcggcuccccgaucgugaaccgggagggcaagaucgucgggcuguacggcaacgggguggugaccaccagcggcacguacgucuccgccaucgcccaggccaaggcgagccaggaggggccccugcccgagaucgaggacgagguguucaagaagcgcaaccucaccaucauggaccugcacccgggcagcggcaagacccggcgcuaccugcccgccaucgugcgggaggccaucaagcgcaagcuccgcacccugauccuggcccccacgcgggucguggcguccgagauggccgaggcccucaaggggaugcccauccgcuaccagaccaccgccgucaagagcgagcacaccggccgggagaucgucgaccugaugugccacgccacguucaccaugcgccugcucuccccggugcgggugcccaacuacaacaugaucaucauggacgaggcgcacuucaccgaccccgccagcaucgccgcccgcggguacaucuccacccgggucggcaugggggaggccgcggccaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgcgaacugccugcgcaagaacgggaagcgggugauccagcugagccgcaagacguucgacaccgaguaccagaagaccaagaacaacgacugggacuacgucgugaccacggacaucuccgagaugggcgccaacuuccgggccgaccgcgugaucgacccccggcgcugccucaagcccgucauccugaaggacgggcccgagcgggugauccuggccggcccgaugcccgucaccguggcgagcgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcgcggaccuacuccgacccgcuggcccuccgcgaguucaaggaguucgccgccggccggcgcagcgugagcggcgaccugauccuggagaucgggaagcucccccagcaccugacccugcgggcccagaacgcgcucgacaaccuggucaugcugcacaacuccgagcagggcgggaaggccuaccgccacgccauggaggagcuccccgacaccaucgagacgcugaugcugcucgcccugaucgcggugcugaccggcggggugacccucuucuuccugagcggcaagggccuggggaagaccuccaucggccuccugugcgucacggccagcuccgcccugcucuggauggccagcguggagccccacuggaucgccgcguccaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccagcgccuggacccuguacgccguggcgaccacggucaucacccccaugaugcggcacaccaucgagaacaccacggccaacaucucccucaccgccaucgccaaccaggccgcgauccugaugggccuggacaagggguggcccaucagcaagauggacaucggcgugccccuccuggcccuggggugcuacucccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccagccagauccugcugaugcggacgaccugggcccucugcgaguccaucacccuggcgaccggcccgcugacgacccucugggaggggagccccggcaaguucuggaacaccaccaucgccgucuccauggccaacaucuuccgcggcagcuaccuggccggggccggccuggcguucucccucaugaagucccucgggggcgggcggcgcgggacgggcgcccagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgugagccggggcaccgcgaagcuccgcugguucgucgagcggaaccuggugaagcccgagggcaaggugaucgaccuggggugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccggacccugcgcgugcugaagaugguggagcccuggcuccggggcaaccaguucugcaucaagauccugaaccccuacaugccguccgucguggagacccuggagcagaugcagcgcaagcacgggggcaugcucgugcggaacccccugagccgcaacuccacgcacgagauguacugggucagcugcgggaccggcaacaucguguccgccgugaacaugaccagccggaugcugcucaaccgcuucaccauggcccaccgcaagcccacguacgagcgggacgucgaccugggcgcggggacccgccacguggccguggagcccgaggucgccaaccuggacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccuccugacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcuguggggguuccucucccggaacaagaagccccgcaucugcacccgggaggaguucacccgcaaggugcggagcaacgccgccaucggcgcggucuucguggacgagaaccaguggaacagcgccaaggaggccguggaggacgagcgcuucugggaccugguccaccgggagcgcgagcugcacaagcaggggaagugcgccacgugcguguacaacaugaugggcaagcgggagaagaagcucggggaguucggcaaggcgaagggcucccgcgccaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgccgacgacaccgcgggcugggacacccgcaucaccgaggacgaccugcagaacgaggccaagaucacggacaucauggagcccgagcacgcccuccuggccaccagcaucuucaagcugaccuaccagaacaaggucgugcgcgugcagcggcccgccaagaacgggaccgucauggacgugaucucccgccgggaccagcgcggcagcggccagguggggacguacggccucaacaccuucaccaacauggagguccagcugauccggcagauggaguccgaggggaucuuccugcccagcgagcucgagaccccgaaccuggcggagcgcgcccuggacuggcucgagaagcacggcgccgagcggcugaagcgcauggccaucuccggggacgacugcguggugaagcccaucgacgaccgguucgccacggcgcugaccgcccucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcccgcgugagccagggggccggcuggucccuccgggagaccgccugccugggcaagagcuacgcgcagauguggcagcugauguacuuccaccgccgggaccuccgccuggccgccaacgccaucugcuccgcgguccccguggacugggugcccaccagccggaccacguggagcauccacgcccaccaccaguggaugaccaccgaggacaugcuguccgucuggaaccgcguguggaucgaggagaacccguggauggaggacaagacccacgugagcuccugggaggagguccccuaccucggcaagcgcgaggaccaguggugcggcagccugaucgggcugacggcccgggccaccugggccaccaacauccagguggcgaucaaccaggugcgccggcucaucggcaacgagaacuaccuggacuacaugaccuccaugaagcgcuucaagaacgagagcgaccccgagggggcccugugguga

SEQ ID NO: 8249 - RNA, 9879 nt, Artificial Sequence
  derived and/or modified CDS sequence (opt1) from DENV-1__FJ639815__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccaugcuccugagcaucgugucccuguucccccucugccugagcaccacgucccagaagaccaccuggcugccgguccuccuggggagcuucggcugcaagccccugaccauguuccucaucaccgagaacaagaucugggggcggaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgcgacgacacccucaccauccugcugaaggccacccuccuggccguguccgggguguaccccaugagcauccccgcgacgcuguucgucugguacuucuggcagaagaagaagcagcgguccggcgugcucugggacacccccagcccgcccgagguggagcgcgccguccuggacgacggcaucuaccggauccugcagcgcgggcugcucggccggucccaggugggggugggcgucuuccaggacgggguguuccacaccauguggcacgugacccgcggcgccguccugauguaccagggcaagcggcuggagcccagcugggccuccgugaagaaggaccucaucagcuacgggggcggguggcgcuuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgggagggcaagaucguggggcuguacggcaacggggucgugaccaccagcggcacguacguguccgccaucgcccaggccaaggcgagccaggaggggccccuccccgagaucgaggacgaggucuucaagaagcgcaaccugaccaucauggaccugcacccgggcagcggcaagacccggcgcuaccuccccgccaucgugcgggaggccaucaagcgcaagcugcgcacccugauccucgcccccacgcggguggucgcguccgagauggccgaggcccugaaggggaugcccauccgcuaccagaccaccgccgucaagagcgagcacaccggccgggagaucguggaccugaugugccacgccacguucaccaugcgccuccuguccccgguccgggugcccaacuacaacaugaucaucauggacgaggcgcacuucaccgaccccgccagcaucgccgcccgcggguacaucuccacccgggugggcaugggggaggccgcggccaucuucaugacggccacgccgcccggcagcgucgaggccuucccccaguccaacgccgugauccaggacgaggagcgcgacauccccgagcggagcuggaacuccggcuacgacuggaucaccgacuuccccgggaagaccgugugguucguccccagcaucaaguccggcaacgacaucgcgaacugccugcgcaagaacgggaagcgggugauccagcucagccgcaagacguucgacaccgaguaccagaagaccaagaacaacgacugggacuacguggucaccacggacaucuccgagaugggcgccaacuuccgggccgaccgcgugaucgacccccggcgcugccugaagcccgugauccugaaggacgggcccgagcgggucauccucgccggcccgaugcccgugaccgucgcgagcgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucguggagcucaugcggcgcggcgaccugcccgucuggcugagcuacaagguggccuccgagggguuccaguacagcgaccggcgcuggugcuucgacggcgagcggaacaaccaggugcucgaggagaacauggacgucgagaucuggaccaaggagggggagcgcaagaagcugcggccccgcuggcuggacgcgcggaccuacuccgacccgcucgcccugcgcgaguucaaggaguucgccgccggccggcgcagcgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcacccggccagcgccuggacccucuacgccguggcgaccacggugaucacccccaugaugcggcacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccggacccugcgcguccucaagaugguggagcccuggcugcggggcaaccaguucugcaucaagauccugaaccccuacaugccguccguggucgagacccucgagcagaugcagcgcaagcacgggggcaugcuggugcggaacccccugagccgcaacuccacgcacgagauguacugggugagcugcgggaccggcaacaucgucuccgccgugaacaugaccagccggaugcuccugaaccgcuucaccauggcccaccgcaagcccacguacgagcgggacguggaccugggcgcggggacccgccacgucgccguggagcccgagguggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgccaaguggcucuggggguuccugucccggaacaagaagccccgcaucugcacccgggaggaguucacccgcaaggugcggagcaacgccgccaucggcgcgguguucgucgacgagaaccaguggaacagcgccaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggugguccgcgugcagcggcccgccaagaacgggaccgugauggacgucaucucccgccgggaccagcgcggcagcggccagguggggacguacggccugaacaccuucaccaacauggaggugcagcugauccggcagauggaguccgaggggaucuuccuccccagcgagcuggagaccccgaaccuggcggagcgcgcccucgacuggcuggagaagcacggcgccgagcggcugaagcgcauggccaucuccggggacgacugcgucgugaagcccaucgacgaccgguucgccacggcgcucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcucgucggccgggcccgcgugagccagggggccggcuggucccugcgggagaccgccugccugggcaagagcuacgcgcagauguggcagcucauguacuuccaccgccgggaccugcgccuggccgccaacgccaucugcuccgcggugcccgucgacugggugcccaccagccggaccacguggagcauccacgcccaccaccaguggaugaccaccgaggacaugcucuccguguggaaccgcgucuggaucgaggagaacccguggauggaggacaagacccacgugagcuccugggaggaggugcccuaccugggcaagcgcgaggaccaguggugcggcagccugaucgggcucacggcccgggccaccugggccaccaacauccaggucgcgaucaaccaggugcgccggcugaucggcaacgagaacuaccuggacuacaugaccuccaugaagcgcuucaagaacgagagcgaccccgagggggcccucugguga

SEQ ID NO: 8250 - RNA, 9879 nt, Artificial Sequence
  derived and/or modified CDS sequence (opt1) from DENV-1__FJ639818__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacaccaccgacaccugggugaccuacgggaccugcagccagacgggcgagcaccggcgcgacaagcgguccguggcccuggcgccccacgugggccuggggcucgagacccgcaccgagaccuggaugagcuccgagggcgcguggaagcagauccagcgggucgagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgccgugcuccggaagcugugcaucgaggcgaagaucagcaacaccacgaccgacucccgcugcccgacccagggcgaggccacccugguggaggagcaggacgccaacuucgucugccggcgcacguucguggaccggggcugggggaacggcugcggccucuucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgccaccaucacgccccaggcgcccaccagcgagauccagcugaccgacuacggggcccucacccuggacugcagcccccgcacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgccaagaagcaggaggucguggugcugggcucccaggagggcgcgaugcacaccgcccucacgggggccaccgagauccagaccagcggcaccacgaccaucuucgccgggcaccugaagugccgccugaagauggagaagcucacccugaagggcauguccuacgucaugugcaccgggagcuucaagcuggagaaggagguggccgagacgcagcacggcaccgugcugguccaggugaaguacgagggcaccgacgcgcccugcaagauccccuucuccacccaggacgagaagggggugacgcagaacggccggcucaucaccgccaacccgaucgucaccgacaaggagaagcccgugaacaucgagaccgagccgcccuucggggagagcuacaucguggucggcgccggcgagaaggcccugaagcuguccugguucaagaaggggagcuccaucggcaagauguucgaggcgacggcccgcggggcccggcgcauggccauccucggcgacaccgccugggacuucgggagcaucggcggcguguucaccuccguggggaagcugguccaccagguguucggcaccgcguacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgcgaucggcaaggccugggaggagggggugugcggcauccgguccgccacccgccucgagaacaucauguggaagcagaucagcaacgagcugaaccacauccugcucgagaacgacaugaaguucacggucguggugggggacgccaacggcauccuggcccaggggaagaagaugauccggccccagcccauggagcacaaguacuccuggaaguccuggggcaaggcgaagaucaucggcgccgacauccagaacaccaccuucaucaucgacgggcccgacaccccggagugccccgacggccagcgcgccuggaacaucugggaggucgaggacuacggguucggcaucuucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggugaagacgugcaccuggcccaagagccacacccucugguccaacgggguccuggagagcgagaugaucauccccaagaucuacggcgggccgaucucccagcacaacuaccgccccggcuacuucacccagacggcggggcccuggcaccugggcaagcucgagcuggacuucgaccugugcgagggcaccaccgugguggucgacgagcacugcgggaaccggggcccgagccuccgcaccacgaccgugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugacggggacccuggccguguuccugcuccugaucaugggccagcugaccuggaacgaccucauccgccugugcaucauggucggggccaacgccuccgaccggaugggcaugggcaccacgcaccuggcccucauggccaccuucaagaugcgcccgauguucgccguggggcugcuguuccggcgccucaccagccgggaggugcugcugcucaccaucgggcugucccuggucgccagcguggagcuccccaacucccuggaggagcugggggacggccucgccaugggcaucaugaugcugaagcugcucacggaguuccagccccaccagcuguggaccacccugcucagccugaccuucgucaagacgacccugucccucgacuacgcguggaagaccaccgccauggugcugagcaucgugucccuguucccccucugccugagcacgaccucccagaagaccaccuggcugccgguccuccuggggagcuucggcugcaagccccugaccauguuccucaucacggagaacaagaucugggggcgcaaguccuggccccugaacgagggcaucauggccaucgggaucgugagcauccugcucuccagccugcugaagaacgacgugccccucgccggcccgcugaucgcgggcgggaugcugaucgccugcuacgucaucagcggcuccagcgccgaccucucccuggagaaggccgccgaggugagcugggagcaggaggcggagcacuccggggccagccacaacauccugguggagguccaggacgacggcaccaugaagaucaaggacgaggagcgggacgacacccucaccauccugcugaaggccacgcuccuggccguguccgggguguaccccaugagcauccccgccacccuguucgucugguacuucuggcagaagaagaagcagcgcuccggcgugcucugggacacccccagcccgcccgagguggagcgggcgguccuggacgacggcaucuaccgcauccugcagcgggggcugcucggccgcucccaggugggggugggcgucuuccaggacgggguguuccacaccauguggcacgugacgcggggcgccguccugauguaccagggcaagcgccuggagcccagcugggccuccgugaagaaggaccucaucagcuacgggggcggguggcgguuccagggcuccuggaacaccggggaggaggugcaggucaucgccguggagcccggcaagaacccgaagaacgugcagaccacccccggcacguucaagacccccgagggggaggucggcgccaucgcgcuggacuucaagcccgggaccagcggcuccccgaucgugaaccgcgagggcaagaucguggggcuguacggcaacggggucgugaccacgagcggcaccuacguguccgccaucgcccaggccaaggccagccaggaggggccccuccccgagaucgaggacgaggucuucaagaagcggaaccugaccaucauggaccugcacccgggcagcggcaagacccgccgguaccuccccgcgaucgugcgcgaggccaucaagcggaagcugcgcacgcugauccucgcccccacccgcguggucgccuccgagauggcggaggcccugaaggggaugcccauccgguaccagaccaccgccgucaagagcgagcacacgggccgcgagaucguggaccugaugugccacgccaccuucaccaugcggcuccuguccccgguccgcgugcccaacuacaacaugaucaucauggacgaggcccacuucaccgaccccgcgagcaucgccgcccggggguacaucuccacgcgcgugggcaugggggaggccgccgcgaucuucaugaccgccacgccgcccggcagcgucgaggccuucccccaguccaacgccgugauccaggacgaggagcgggacauccccgagcgcagcuggaacuccggcuacgacuggaucaccgacuuccccgggaagacggugugguucguccccagcaucaaguccggcaacgacaucgccaacugccugcggaagaacgggaagcgcgugauccagcucagccggaagaccuucgacaccgaguaccagaagaccaagaacaacgacugggacuacguggucacgaccgacaucuccgagaugggcgcgaacuuccgcgccgaccgggugaucgacccccgccggugccugaagcccgugauccugaaggacgggcccgagcgcgucauccucgccggcccgaugcccgugaccgucgccagcgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacgcccgagggcaucaucccggcccuguucgagcccgagcgcgagaaguccgcggccaucgacggggaguaccggcugcgcggcgaggcccggaagaccuucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccgcucgcgcugcgggaguucaaggaguucgccgccggccgccggagcgugagcggcgaccugauccucgagaucgggaagcugccccagcaccugacccuccgcgcccagaacgcccuggacaaccuggugaugcuccacaacuccgagcagggcgggaaggcguaccggcacgccauggaggagcugcccgacacgaucgagacccugaugcuccuggcccugaucgccguccucaccggcggggugacccuguucuuccugagcggcaagggccucgggaagacguccaucggccugcugugcgugaccgcgagcuccgcccuccuguggauggccagcgucgagccccacuggaucgccgccuccaucauccuggaguucuuccucauggugcugcugaucccggagcccgaccgccagcggacgccccaggacaaccagcucgcguacguggucaucgggcugcuguucaugauccucaccguggccgccaacgagaugggccugcuggagacgaccaagaaggaccucgggaucggcuacguggccgccgagaaccaccagcacgcgaccaugcuggacgucgaccugcgcccggccagcgccuggacccucuacgccguggccacgaccgugaucacccccaugaugcggcacaccaucgagaacacgaccgcgaacaucucccugaccgccaucgccaaccaggccgccauccugaugggccucgacaagggguggcccaucagcaagauggacaucggcgucccccugcuggcgcucgggugcuacucccaggugaacccgcugacccugacggccgccgugcucaugcuggucgcccacuacgcgaucaucggccccgggcugcaggccaaggccacccgcgaggcccagaagcgcaccgccgcgggcaucaugaagaaccccaccguggacggcaucguggccaucgaccucgaccccgucguguacgacgccaaguucgagaagcagcuggggcagaucaugcugcucauccugugcacgagccagauccugcucaugcggaccaccugggcccugugcgaguccaucacccuggccacgggcccgcucaccacccugugggaggggagccccggcaaguucuggaacaccacgaucgcgguguccauggccaacaucuuccgcggcagcuaccuggccggggccggccucgccuucucccugaugaagucccucgggggcgggcggcgcgggaccggcgcgcagggggagacccucggcgagaaguggaagcggcagcugaaccagcuguccaagagcgaguucaacaccuacaagcgcagcgggaucauggaggucgaccgguccgaggccaaggagggccucaagcgcggggagacgaccaagcacgccgugagccggggcaccgccaagcugcgcugguucguggagcggaaccuggucaagcccgagggcaaggugaucgaccuggggugcggccgcgggggcugguccuacuacugcgcggggcucaagaaggugaccgaggucaagggcuacaccaagggcgggcccggccacgaggagccgauccccauggccacguacggguggaaccuggugaagcugcacagcggcaaggacguguucuucaugccgcccgagaagugcgacacccuccugugcgacaucggggaguccagcccgaaccccaccaucgaggagggccggacccugcgcguccucaagaugguggagcccuggcugaagggcaaccaguucugcaucaagauccugaaccccuacaugccguccguggucgagacgcucgagcagaugcagcggaagcacgggggcaugcuggugcgcaacccccugagccggaacuccacccacgagauguacugggugagcugcgggaccggcaacaucgucuccgccgugaacaugaccagccgcaugcuccugaaccgguucacgauggcccaccgcaagcccaccuacgagcgcgacguggaccugggcgccgggacccggcacgucgcgguggagcccgagguggccaaccucgacaucaucggccagcgcaucgagaacaucaagaacgagcacaaguccaccuggcacuacgacgaggacaacccguacaagacgugggccuaccacgggagcuacgaggucaagcccuccggcagcgccuccagcauggugaacggggucgugcggcugcugaccaagcccugggacgugauccccauggucacccagaucgccaugaccgacacgaccccguucggccagcagcgcguguucaaggagaagguggacacccggacgccccgcgcgaagcggggcacgacccagaucauggaggucaccgccaaguggcucuggggguuccugucccgcaacaagaagccccggaucugcacccgcgaggaguucacgcggaaggugcgcagcaacgccgccaucggcgccguguucgucgacgagaaccaguggaacagcgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaagggcucccgggcgaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgccggcugggacacccggaucacggaggacgaccuccagaacgaggcgaagaucaccgacaucauggagcccgagcacgcccugcuggccaccagcaucuucaagcucaccuaccagaacaaggugguccgcgugcagcgccccgccaagaacgggacggugauggacgucaucucccggcgcgaccagcggggcagcggccagguggggaccuacggccugaacaccuucaccaacauggaggugcagcugauccgccagauggaguccgaggggaucuuccuccccagcgagcuggagacgccgaaccuggccgagcggguccucgacuggcuggagaagcacggcgcggagcgccugaagcggauggccaucuccggggacgacugcguggugaagcccaucgacgaccgcuucgccaccgcccucaccgcccugaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcgcgggugagccagggggccggcuggucccugcgcgagaccgccugccugggcaagagcuacgcccagauguggcagcucauguacuuccaccggcgcgaccugcggcuggccgcgaacgccaucugcuccgccguccccguggacugggugcccaccagccgcacgaccuggagcauccacgcccaccaccaguggaugaccaccgaggacaugcucuccgucuggaaccggguguggaucgaggagaacccguggauggaggacaagacgcacgugagcuccugggaggagguccccuaccugggcaagcgcgaggaccaguggugcggcagccugaucgggcucaccgcgcgcgccaccugggccaccaacauccagguggccaucaaccaggugcggcgccugaucggcaacgagaacuaccuggacuacaugacguccaugaagcgguucaagaacgagagcgaccccgagggggcccucugguga

SEQ ID NO: 8251 - RNA, 9879 nt, Artificial Sequence
  derived and/or modified CDS sequence (opt1) from DENV-1__FJ639819__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcaucuucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggugaagaccugcacguggcccaagagccacacccugugguccaacgggguccucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccgugguggucgacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgugaaggagaaggaggagaaccugguccgcagcaugguguccgccggcagcggggagguggacaacuucagccucggcauccugugcgucuccaucaugaucgaggaggugaugcggagccgcuggucccgcaagaugcugaugaccgggacgcucgccguguuccugcugcucaucaugggccagcugaccuggaacgaccugauccggcucugcaucauggucggggccaacgcgagcgaccgcaugggcaugggcaccaccuaccuggcccugauggccacguucaagaugcggccgauguucgccguggggcuccuguuccgccggcugaccucccgcgaggugcuccugcugaccaucggccucagccuggucgccuccguggagcugcccaacagccucgaggagcugggggacggccuggcgaugggcaucaugaugcucaagcugcugaccgaguuccagccccaccagcucuggacgacccugcugucccucaccuucgucaagaccacgcugagccuggacuacgccuggaagaccaccgccauggugcucuccaucgugagccuguucccccugugccucuccaccacgagccagaagaccaccuggcugccgguccugcucggguccuucggcugcaagccccugaccauguuccugaucaccgagaacaagaucugggggcgcaagagcuggccccucaacgagggcaucauggccaucgggaucguguccauccugcugagcucccuccugaagaacgacgugccccuggcgggcccgcucaucgccggcgggaugcugaucgccugcuacgucaucagcggcagcuccgccgaccugagccucgagaaggccgcggagguguccugggagcaggaggccgagcacagcggggccucccacaacauccugguggagguccaggacgacggcacgaugaagaucaaggacgaggagcgcgacgacacccugaccauccuccugaaggccacccugcucgccgugagcgggguguaccccauguccauccccgcgacgcuguucgucugguacuucuggcagaagaagaagcagcggagcggcgugcugugggacacccccuccccgcccgagguggagcgcgccguccucgacgacggcaucuaccggauccugcagcgcgggcugcugggccggagccaggugggggugggcgucuuccaggacgggguguuccacaccauguggcacgugacccgcggcgccguccucauguaccagggcaagcggcuggagcccuccugggccugcgugaagaaggaccugaucagcuacgggggcggguggcgcuuccagggccucuggaacacgggggaggaggugcaggucaucgccguggagcccggcaagaacccgaagaacgugcagaccacccccggcaccuucaagacgcccgagggggaggucggcgcgaucgcccuggacuucaagcccgggaccuccggcagcccgaucgugaaccgggagggcaagaucguggggcuguacggcaacggggucgugaccaccuccggcacguacgugagcgccaucgcccaggccaaggcgucccaggaggggccccuccccgagaucgaggacgaggucuucaagaagcgcaaccugaccaucauggaccugcacccgggcagcggcaagacccggcgcuaccuccccgccaucgugcgggaggccaucaagcgcaagcugcgcacccugauccucgcccccacgcggguggucgcguccgagauggccgaggcccugaaggggaugcccauccgcuaccagaccaccgccgucaagagcgagcacaccggccgggagaucguggaccugaugugccacgccacguucaccaugcgccuccugagcccgguccgggugcccaacuacaacaugaucaucauggacgaggcgcacuucaccgaccccgccuccaucgccgcccgcggguacaucagcacccgggugggcaugggggaggccgcggccaucuucaugacggccacgccgcccggcuccgucgaggccuucccccagagcaacgccgugauccaggacgaggagcgcgacauccccgagcgguccuggaacagcggcuacgacuggaucaccgacuuccccgggaagaccgugugguucguccccuccaucaagagcggcaacgacaucgcgaacugccugcgcaagaacgggaagcgggugauccagcucucccgcaagacguucgacaccgaguaccagaagaccaagaacaacgacugggacuacguggucaccacggacaucagcgagaugggcgccaacuuccgggccgaccgcgugaucgacccccggcgcugccugaagcccgugauccugaaggacgggcccgagcgggucauccucgccggcccgaugcccgugaccgucgcguccgccgcccagcgccggggccgcaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgggagaaguccgccgccaucgacggggaguaccgccugcggggcgaggcccgcaagacguucguggagcucaugcggcgcggcgaccugcccgucuggcuguccuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcgcggaccuacagcgacccgcucgcccugcgcgaguucaaggaguucgccgccggccggcgcuccgugagcggcgaccugauccucgagaucgggaagcugccccagcaccugacccuccgggcccagaacgcgcuggacaaccuggugaugcuccacaacuccgagcagggcgggaaggccuaccgccacgccauggaggagcugcccgacaccaucgagacgcugaugcuccuggcccugaucgcgguccucaccggcggggugacccuguucuuccugagcggcaagggccucgggaagaccagcaucggccugcugugcgugacggccuccagcgcccuccuguggauggccuccgucgagccccacuggaucgccgcgagcaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcacccggccuccgccuggacccucuacgccguggcgaccacggugaucacccccaugaugcggcacaccaucgagaacaccacggccaacaucagccugaccgccaucgccaaccaggccgcgauccugaugggccucgacaagggguggcccaucuccaagauggacaucggcgucccccugcuggcccucgggugcuacagccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccucccagauccugcucaugcggacgaccugggcccugugcgagagcaucacccuggcgaccggcccgcucacgacccugugggaggggucccccggcaaguucuggaacaccaccaucgccgugagcauggccaacaucuuccgcggcuccuaccuggccggggccggccucgcguucagccugaugaagucccucgggggcgggcggcgcggcacgggcgcccagggggagacccucggcgagaaguggaagcggcagcugaaccagcugagcaaguccgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcuggagcuacuacugcgccgggcucaagaaggugaccgaggucaagggcuacaccaagggcgggcccggccacgaggagccgauccccauggccaccuacggguggaaccuggugaagcugcacuccggcaaggacguguucuucaugccgcccgagaagugcgacacgcuccugugcgacaucggggagagcuccccgaaccccaccaucgaggagggccggacccugcgcguccucaagaugguggagcccuggcugcggggcaaccaguucugcaucaagauccugaaccccuacaugccgagcguggucgagacccucgagcagaugcagcgcaagcacgggggcaugcuggugcggaacccccugucccgcaacagcacgcacgagauguacuggguguccugcgggaccggcaacaucgucagcgccgugaacaugaccucccggaugcuccugaaccgcuucaccauggcccaccgcaagcccacguacgagcgggacguggaccugggcgcggggacccgccacgucgccguggagcccgagguggccaaccucgacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggucgugcgccugcugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgccaaguggcucuggggguuccugagccggaacaagaagccccgcaucugcacccgggaggaguucacccgcaaggugcgguccaacgccgccaucggcgcgguguucgucgacgagaaccaguggaacagcgccaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacagccuguccgggguggagggcgaggggcuccacaagcugggcuacauccugcgggacaucagcaagaucccgggcgggaacauguacgccgacgacaccgcgggcugggacacccgcaucaccgaggacgaccuccagaacgaggccaagaucacggacaucauggagcccgagcacgcccugcuggccaccuccaucuucaagcucaccuaccagaacaaggugguccgcgugcagcggcccgccaagaacgggaccgugauggacgucaucagccgccgggaccagcgcggcuccggccagguggggacguacggccugaacaccuucaccaacauggaggugcagcugauccggcagauggagagcgaggggaucuuccuccccuccgagcuggagaccccgaaccuggcggagcgcguccucgacuggcuggagaagcacggcgccgagcggcugaagcgcauggccaucagcggggacgacugcguggugaagcccaucgacgaccgguucgccacggcccucaccgcgcugaacgacaugggcaagguccgcaaggacaucccccagugggagcccuccaagggcuggaacgacuggcagcaggucccguucugcagccaccacuuccaccagcugaucaugaaggacgggcgggagaucgugguccccugccgcaaccaggacgagcucgugggccgggcccgcgugucccagggggccggcuggagccugcgggagaccgccugccuggggaaguccuacgcccagauguggcagcucauguacuuccaccgccgggaccugcgccuggcggccaacgccaucugcagcgccguccccguggacugggugcccaccucccggaccacguggagcauccacgcgcaccaccaguggaugaccaccgaggacaugcucuccgucuggaaccgcguguggaucgaggagaacccguggauggaggacaagacccacgugagcagcugggaggagguccccuaccugggcaagcgcgaggaccaguggugcggcucccugaucgggcucacggcccgggccaccugggccaccaacauccagguggccaucaaccaggugcgccggcugaucggcaacgagaacuaccuggacuacaugaccagcaugaagcgcuucaagaacgaguccgaccccgagggggcgcucugguga

SEQ ID NO: 8252 - RNA, 9879 nt, Artificial Sequence
  derived and/or modified CDS sequence (opt1) from DENV-1__FJ639820__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggccaugcuccacaacuccgagcagggcgggaaggccuaccggcacgccauggaggagcugcccgacaccaucgagacgcugaugcuccuggcgcugaucgccgugcucaccggcggggucacccuguucuuccugagcggcaagggccucgggaagaccuccaucggccugcugugcgugacggccagcuccgcccuccuguggauggccagcguggagccccacuggaucgcggccuccaucauccuggaguucuuccucaugguccugcugaucccggagcccgaccgccagcggacgccccaggacaaccagcucgccuacguggugaucgggcugcuguucaugauccucaccgucgccgccaacgagaugggccugcuggagaccacgaagaaggaccucgggaucggcuacguggcggccgagaaccaccagcacgccaccaugcuggacguggaccugcgcccggccagcgccuggacccucuacgcggucgccaccacggugaucacccccaugaugcggcacaccaucgagaacaccacggccaacaucucccugaccgccaucgccaaccaggcggccauccugaugggccucgacaagggguggcccaucagcaagauggacaucggcgugccccugcuggcccucgggugcuacucccaggucaacccgcugacccugaccgccgcggugcucaugcugguggcccacuacgccaucaucggccccgggcugcaggccaaggccacgcgcgaggcgcagaagcgcaccgccgccggcaucaugaagaaccccaccgucgacggcaucguggccaucgaccucgaccccguggucuacgacgccaaguucgagaagcagcuggggcagaucaugcugcucauccugugcaccagccagauccugcucaugcggacgaccugggcgcugugcgaguccaucacccuggccaccggcccgcucacgacccugugggaggggagccccggcaaguucuggaacaccaccaucgccguguccauggccaacaucuuccgcggcagcuaccuggccggggcgggccucgccuucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgcggucagccggggcaccgccaagcugcgcugguucguggagcggaaccuggugaagcccgagggcaaggucaucgaccuggggugcggccgcgggggcugguccuacuacugcgccgggcucaagaaggugaccgaggugaagggcuacaccaagggcgggcccggccacgaggagccgauccccauggccaccuacggguggaaccuggucaagcugcacagcggcaaggacguguucuucaugccgcccgagaagugcgacacgcuccugugcgacaucggggaguccagcccgaaccccaccaucgaggagggccggacccugcgcgugcucaagauggucgagcccuggcugaagggcaaccaguucugcaucaagauccugaaccccuacaugccguccgugguggagacccucgagcagaugcagcggaagcacgggggcaugcugguccgcaacccccugagccggaacuccacgcacgagauguacugggugagcugcgggaccggcaacaucguguccgccgucaacaugaccagccgcaugcuccugaaccgguucaccauggcgcaccgcaagcccacguacgagcgcgacguggaccugggcgccgggacccggcacguggccgucgagcccgagguggccaaccucgacaucaucggccagcgcaucgagaacaucaagaacgagcacaaguccaccuggcacuacgacgaggacaacccguacaagaccugggccuaccacgggagcuacgaggugaagcccuccggcagcgcguccagcauggucaacggggugguccggcugcugacgaagcccugggacgugauccccauggugacccagaucgccaugaccgacaccacgccguucggccagcagcgcgucuucaaggagaagguggacacccggacgccccgcgccaagcggggcaccacgcagaucauggaggugaccgccaaguggcucuggggguuccugucccgcaacaagaagccccggaucugcacccgcgaggaguucacccggaagguccgcagcaacgccgcgaucggcgccguguucguggacgagaaccaguggaacagcgccaaggaggccgucgaggacgagcgguucugggaccuggugcaccgcgagcgggagcuccacaagcaggggaagugcgcgacgugcguguacaacaugaugggcaagcgcgagaagaagcugggggaguucggcaaggccaagggcucccgggccaucugguacauguggcugggggcccgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgcggacgacaccgccggcugggacacccggaucaccgaggacgaccuccagaacgaggccaagaucacggacaucauggagcccgagcacgcccugcuggccaccagcaucuucaagcucaccuaccagaacaagguggugcgcguccagcgccccgcgaagaacgggaccgugauggacgugaucucccggcgcgaccagcggggcagcggccaggucgggacguacggccugaacaccuucaccaacauggaggugcagcugauccgccagauggaguccgaggggaucuuccuccccagcgagcuggagaccccgaaccuggccgagcgggugcucgacuggcuggagaagcacggcgccgagcgccugaagcggauggccaucuccggggacgacugcgucgugaagcccaucgacgaccgcuucgccacggcgcucaccgcccugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccugggcaagcgcgaggaccaguggugcggcagccugaucgggcucacggcccgcgccaccugggccaccaacauccaggucgcgaucaaccaggugcggcgccugaucggcaacgagaacuaccuggacuacaugaccuccaugaagcgguucaagaacgagagcgaccccgagggggcccucugguga

SEQ ID NO: 8253 - RNA, 9879 nt, Artificial Sequence
  derived and/or modified CDS sequence (opt1) from DENV-1__FJ639821__SS-prME
agcgccaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccgucgcgcuggcgccccacgugggccuggggcucgagacgcgcaccgagaccuggaugagcuccgagggcgccuggaagcagauccagcggguggagaccugggcccugcgccacccgggguucacggugaucgccuucuuccuggcccacgccaucggcaccagcaucacccagaaggggaucaucuucauccuccugaugcuggugacccccuccauggccaugcggugcgugggcaucggcaaccgcgacuucgucgaggggcucagcggcgccacguggguggacgugguccuggagcacggguccugcgugaccaccauggcgaagaacaagcccacccuggacaucgagcuccugaagacggaggugaccaaccccgccguccugcggaagcucugcaucgaggccaagaucagcaacaccaccacggacucccgcugcccgacccagggcgaggccacccugguggaggagcaggacgccaacuucgugugccggcgcaccuucgucgaccggggcugggggaacggcugcgggcuguucggcaaggggagccuccugacgugcgcgaaguucaagugcgugaccaagcuggagggcaagaucgugcaguacgagaaccucaaguacuccgucaucgugaccgugcacaccggcgaccagcaccaggucgggaacgagacgaccgagcacggcaccaucgccaccaucacgccccaggcccccacgagcgagauccagcugaccgacuacggggcccugacccucgacugcagcccccggaccggccuggacuucaacgagauggugcugcucacgaugaaggagaaguccuggcugguccacaagcagugguuccuggaccucccgcugcccuggaccuccggggccagcaccagccaggagaccuggaaccggcaggaccugcucgugacguucaagaccgcgcacgccaagaagcaggagguggucgugcugggcucccaggagggcgccaugcacaccgcccugaccggggccacggagauccagaccagcggcaccaccacgaucuucgcggggcaccucaagugccgccugaagauggacaagcugacccucaagggcauguccuacgugaugugcaccgggagcuucaagcuggagaaggaggucgccgagacccagcacggcacggugcuggugcagguccgguacgagggcaccgacgcccccugcaagauccccuucuccacccaggacgagaagggggugacccagaacggccgccugaucacggccaacccgaucgugaccgacaaggagaagcccgucaacaucgagaccgagccgcccuucggggagagcuacaucguggugggcgcgggcgagaaggcccucaagcuguccugguucaagcgggggagcuccaucggcaagauguucgaggccaccgcccgcggggcccgccggauggcgauccugggcgacacggccugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgacagcgggugcgugaucaacuggaagggccgggagcucaagugcggguccggcaucuucgugacgaacgagguccacaccuggaccgagcaguacaaguuccaggcggacagcccgaagcgccugagcgccgccaucggcaaggccugggaggagggggugugcggcauccgguccgccacccgccuggagaacaucauguggaagcagaucagcaacgagcucaaccacauccugcuggagaacgacaugaaguucaccguggucgugggggacgcgaacggcauccucgcccaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgcguggaacaucugggagguggaggacuacggguucggcaucuucaccacgaacaucuggcugaagcugcgggacuccuacacccagaugugcgaccaccgccucaugagcgccgccaucaaggacuccaaggccguccacgccgacaugggcuacuggaucgagagcgagaagaacgagaccuggaagcuggcgcgggccuccuucaucgaggugaagaccugcacguggcccaagagccacacccugugguccaacggggugcucgagagcgagaugaucauccccaagaucuacggcgggccgaucucccagcacaacuaccgccccggcuacuacacccagaccgccgggcccuggcaccugggcaagcuggagcucgacuucgaccugugcgagggcacgaccgucgugguggacgagcacugcgggaaccggggcccgagccugcgcaccaccacggucaccgggaagaucauccacgaguggugcugccgguccugcacccugccgccccugcgcuuccggggcgaggacgggugcugguacggcauggagauccgccccgugaaggagaaggaggagaaccuggugcggagcauggucuccgccggcagcggggagguggacaacuucagccucggcauccugugcguguccaucaugaucgaggaggucaugcgcagccgcuggucccggaagaugcugaugaccgggacgcucgccguguuccugcugcucaucaugggccagcugaccuggaacgaccugauccgccucugcaucauggugggggcgaacgccagcgacggcaugggcauggggaccaccuaccuggcccugauggccacguucaagaugcggccgauguucgccgucggccuccuguuccgccggcugaccucccgcgaggugcuccugcugaccaucgggcucagccugguggcguccgucgagcugcccaacagccucgaggagcugggcgacggccuggccauggggaucaugaugcucaagcugcugaccgaguuccagccccaccagcucuggacgacccugcugucccucaccuucgugaagaccacgcugagccuggacuacgccuggaagaccaccgccaugguccucuccaucgugagccuguucccccugugccucuccaccacgagccagaagaccaccuggcugccggugcugcucggcuccuucgggugcaagccccugaccauguuccugaucaccgagaacaagaucuggggccgcaagagcuggccccucaacgaggggaucauggcgaucggcaucgucuccauccugcugagcucccuccugaagaacgacgugccccuggccggcccgcucaucgccgggggcaugcugaucgccugcuacgugaucagcgggagcuccgccgaccugagccucgacaaggcggccgaggucuccugggagcaggaggccgagcacagcggcgccucccacaacaucagcguggaggugcaggacgacgggacgaugaagaucaaggacgaggagcgcgacgacacccugaccauccugcucaaggccacccugcuggcggucuccggcguguaccccaugagcauccccgccacccucuucgugugguacuucuggcagaagaagaagcagcgguccggcguccugugggacacccccagcccgcccgagguggagcgcgccgugcuggacgacgggaucuaccggauccuccagcgcggccugcuggggcggucccaggucggcguggggguguuccaggacggcgucuuccacaccauguggcacgugacccgcggcgccgugcugauguaccaggggaagcggcucgagcccagcugggccugcgucaagaaggaccugaucuccuacggcgggggcuggcgcuuccaggggagcuggaacacgggcgaggagguccaggugaucgcggucgagcccggcaagaacccgaagaacgugcagaccacccccgggaccuucaagacgcccgagggcgaggugggggccaucgcccuggacuucaagcccggcaccuccggcagcccgaucgucaaccgggaggggaagaucgugggccucuacgggaacggcguggucaccaccuccgggacguacgugagcgccaucgcccaggcgaaggccucccaggagggcccccugcccgagaucgaggacgagguguucaagaagcgcaaccugaccaucauggaccuccacccgggcagcgggaagacccggcgcuaccugcccgccaucguccgggaggccaucaagcgcaagcugcgcacccucauccuggcgcccacgcgggugguggccagcgagauggccgaggcccugaagggcaugcccauccgcuaccagaccaccgccgucaaguccgagcacaccgggcgggagaucguggaccucaugugccacgcgacguucaccaugcgccugcugagcccggugcggguccccaacuacaacaugaucaucauggacgaggcccacuucaccgaccccgccuccaucgccgcccgcggcuacaucagcacccggguggggaugggcgaggcggccgccaucuucaugacggccacgccgcccggcuccguggaggccuucccccagagcaacgcggucauccaggacgaggagcgcgacauccccgagcgguccuggaacagcggguacgacuggaucaccgacuuccccggcaagaccgugugguucgugcccuccaucaagagcgggaacgacaucgccaacugccuccgcaagaacggcaagcgggucauccagcugucccgcaagacguucgacaccgaguaccagaagaccaagaacaacgacugggacuacguggugaccacggacaucagcgagaugggggccaacuuccgggccgaccgcgucaucgacccccggcgcugccugaagcccgugauccucaaggacggccccgagcgggugauccuggcgggcccgaugcccgucaccguggccuccgccgcccagcgccgggggcgcaucggccgcaaccagaacaaggagggggaccaguacgucuacaugggccagccccugaacaacgacgaggaccacgcccacuggaccgaggcgaagaugcuccuggacaacaucaacacccccgaggggaucaucccggcccuguucgagcccgagcgggagaaguccgccgccaucgacggcgaguaccgccuccggggcgaggcccgcaagacguucguggagcugaugcggcgcggggaccugcccguguggcucuccuacaaggucgcgagcgagggcuuccaguacuccgaccggcgcuggugcuucgacggggagcggaacaaccaggugcuggaggagaacauggacguggagaucuggaccaaggagggcgagcgcaagaagcugcggccccgcuggcucgacgcccggaccuacagcgacccgcuggcccugcgcgaguucaaggaguucgccgccggccggcgcuccgucagcggggaccucauccuggagaucggcaagcugccccagcaccucacccugcgggcgcagaacgcccuggacaaccucgugaugcugcacaacagcgagcagggcgggaaggccuaccgccacgccauggaggagcugcccgacaccaucgagacgcucaugcugcuggcgcucaucgccgugcugaccgggggcgucacccuguucuuccucuccggcaaggggcugggcaagaccagcaucgggcugcucugcgugacggccuccagcgcccugcuguggauggccuccguggagccccacuggaucgcggccagcaucauccucgaguucuuccugaugguccugcucaucccggagcccgaccggcagcgcacgccccaggacaaccagcuggccuacguggugaucggccuccucuucaugauccugaccgucgccgccaacgagauggggcugcucgagaccacgaagaaggaccugggcaucggcuacguggcggccgagaaccaccagcacgccaccaugcuggacguggaccuccacccggccuccgccuggacccuguacgcggucgccaccacggugaucacccccaugaugcggcacaccaucgagaacaccacggccaacaucagccugaccgccaucgccaaccaggcggccauccucauggggcuggacaagggcuggcccaucuccaagauggacaucggggugccccugcucgcccugggcugcuacagccaggucaacccgcugacccucaccgccgcggugcugaugcugguggcccacuacgccaucaucgggcccggccuccaggccaaggccacgcgcgaggcgcagaagcgcaccgccgccggcaucaugaagaaccccaccgucgacgggaucguggccaucgaccuggaccccguggucuacgacgugaaguucgagaagcagcugggccagaucaugcuccugauccugugcaccucccagauccuccugaugcggacgaccugggcccugugcgagagcaucacccucgcgaccgggccgcugacgacccugugggagggcucccccggcaaguucuggaacaccaccaucgccgugagcauggccaacaucuuccgcggguccuaccucgccggcgccgggcuggcguucagccugaugaagucccucggcgggggccggcgcggcacgggggcccagggcgagacccugggggagaaguggaagcggcagcugaaccagcucagcaaguccgaguucaacaccuacaagcgcagcggcaucauggaggucgaccggagcgaggccaaggaggggcugaagcgcggcgagaccacgaaccacgccgugucccggggcaccgcgaagcugcgcugguucguggagcggaaccucgucaagcccgaggggaaggugaucgaccugggcugcgggcgcggcggguggagcuacuacugcgccggccugaagaaggugaccgaggucaagggcuacaccaagggcgggcccgggcacgaggagccgauccccauggccaccuacggcuggaaccuggugaagcuccacuccgggaaggacguguucuucaugccgcccgagaagugcgacacgcugcugugcgacaucggcgagagcuccccgaaccccaccaucgaggagggccggacccuccgcguccugaagaugguggagcccuggcugcgggggaaccaguucugcaucaagauccucaaccccuacaugccgagcguggucgagacccuggagcagaugcagcgcaagcacggcgggaugcuggugcggaacccccucucccgcaacagcacgcacgagauguacuggguguccugcggcaccggcaacaucgucagcgccgugaacaugaccucccggaugcugcugaaccgcuucaccauggcccaccgcaagcccacguacgagcgggacguggaccucggggcgggcacccgccacgucaccguggagcccgagguggccaaccuggacaucaucgggcagcggaucgagaacaucaagaacgagcacaagagcaccuggcacuacgacgaggacaacccguacaagacgugggccuaccacggcuccuacgaggucaagcccagcggguccgccagcuccauggugaacggcgucgugcgccugcucaccaagcccugggacgugauccccauggucacccagaucgccaugaccgacacgaccccguucggccagcagcggguguucaaggagaagguggacacccgcacgccccgggcgaagcgcgggacgacccagaucauggaggucaccgccaaguggcuguggggcuuccugagccggaacaagaagccccgcaucugcacccgggaggaguucacgcgcaaggugcgguccaacgccgccaucggggccguguucgucgacgagaaccaguggaacagcgcgaaggaggccguggaggacgagcgcuucugggaccucgugcaccgggagcgcgagcugcacaagcagggcaagugcgcgaccugcgucuacaacaugauggggaagcgggagaagaagcugggcgaguucggcaaggccaaggggagccgcgcgaucugguacauguggcucggcgcccgguuccuggaguucgaggcccugggguucaugaacgaggaccacugguucucccgcgagaacagccucuccggcguggagggggagggccugcacaagcugggcuacauccuccgggacaucagcaagauccccggcgggaacauguacgccgacgacaccgccgggugggacacccgcaucacggaggacgaccugcagaacgaggcgaagaucaccgacaucauggagcccgagcacgcccugcucgccaccuccaucuucaagcugaccuaccagaacaaggugguccgcgugcagcggcccgccaagaacgggacggugauggacgucaucagccgccgggaccagcgcggcuccggccaggugggcaccuacgggcugaacaccuucaccaacauggaggugcagcucauccggcagauggagagcgagggcaucuuccugcccuccgagcuggagacgccgaaccucgccgagcgcguccuggacuggcuggagaagcacggggcggagcggcucaagcgcauggccaucagcggcgacgacugcguggugaagcccaucgacgaccgguucgccaccgcccugaccgcccugaacgacaugggcaagguccgcaaggacaucccccagugggagcccuccaagggguggaacgacuggcagcaggucccguucugcagccaccacuuccaccagcucaucaugaaggacggccgggagaucgugguccccugccgcaaccaggacgagcugguggggcgggcgcgcgugucccagggcgccggguggagccugcgggagaccgccugccucggcaaguccuacgcccagauguggcagcugauguacuuccaccgccgggaccugcgccucgccgcgaacgccaucugcagcgccguccccguggacugggugcccaccucccggacgaccuggagcauccacgcccaccaccaguggaugaccaccgaggacaugcugagcgucuggaaccgcguguggaucgaggagaacccguggauggaggacaagacgcacguguccagcugggaggagguccccuaccugggcaagcgcgaggaccaguggugcgggucccucaucggccugaccgcgcgggccaccugggccaccaacauccagguggccaucaaccaggugcgccggcugaucgggaacgagaacuaccucgacuacaugacgagcaugaagcgcuucaagaacgaguccgaccccgagggcgcccugugguga

SEQ ID NO: 8254 - RNA, 9879 nt, Artificial Sequence
  derived and/or modified CDS sequence (opt1) from DENV-1__FJ639824__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcuggucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgcgacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccuccccgagaucgaggacgagguguucaagaagcggaaccugaccaucauggaccugcacccgggcagcggcaagacccgccgguaccuccccgccaucgugcgcgaggccaucaagcggaagcugcgcacccugauccucgcccccacgcgcgucguggcguccgagauggccgaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgccggcccgaugcccgucaccguggcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggucaugcuccacaacuccgagcagggcgggaaggccuaccggcacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgccgcggagaaccaccagcacgccaccaugcuggacguggaccugcgcccggccagcgccuggacccucuacgccguggcgaccacggucaucacccccaugaugcggcacaccaucgagaacaccacggccaacaucucccugaccgccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacgcgcgaggcccagaagcgcaccgcggccggcaucaugaagaaccccaccguggacggcaucgucgccaucgaccucgaccccgugguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccgucuccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgugagccggggcaccgcgaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccggacccugcgcgugcucaagaugguggagcccuggcugaagggcaaccaguucugcaucaagauccugaaccccuacaugccguccgucguggagacccucgagcagaugcagcggaagcacgggggcaugcuggugcgcaacccccugagccggaacuccacgcacgagauguacugggucagcugcgggaccggcaacaucguguccgccgugaacaugaccagccgcaugcuccugaaccgguucaccauggcccaccgcaagcccacguacgagcgcgacgucgaccugggcgcggggacccggcacguggccguggagcccgaggucgccaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcugcugacgaagcccugggacgucauccccauggugacccagaucgcgaugaccgacaccacgccguucggccagcagcgcguguucaaggagaaggucgacacccggacgccccgcgccaagcggggcaccacgcagaucauggaggugaccgccaaguggcucuggggguuccugucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccggaucaccgaggacgaccuccagaacgaggccaagaucacggacaucauggagcccgagcacgcccugcuggccaccagcaucuucaagcucaccuaccagaacaaggucgugcgcgugcagcgccccgccaagaacgggaccgucauggacgugaucucccggcgcgaccagcggggcagcggccagguggggacguacggccugaacaccuucaccaacauggagguccagcugauccgccagauggaguccgaggggaucuuccuccccagcgagcuggagaccccgaaccuggcggagcgggugcucgacuggcuggagaagcacggcgccgagcgccugaagcggauggccaucuccggggacgacugcguggucaagcccaucgacgaccgcuucgccacggcccucaccgcgcugaacgacaugggcaaggugcggaaggacaucccccagugggagcccagcaagggcuggaacgacuggcagcaggucccguucugcucccaccacuuccaccagcugaucaugaaggacgggcgcgagaucgucgugcccugccggaaccaggacgagcucgugggccgcgcccgggucagccagggggccggcuggucccugcgcgagaccgccugccugggcaagagcuacgcccagauguggcagcucauguacuuccaccggcgcgaccugcggcuggcggccaacgccaucugcuccgccgugcccguggacuggguccccaccagccgcaccacguggagcauccacgcgcaccaccaguggaugaccaccgaggacaugcucuccguguggaaccggguguggaucgaggagaacccguggauggaggacaagacccacgucagcuccugggaggaggugcccuaccugggcaagcgcgaggaccaguggugcggcagccugaucgggcucacggcccgcgccaccugggccaccaacauccagguggccaucaaccagguccggcgccugaucggcaacgagaacuaccuggacuacaugaccuccaugaagcgguucaagaacgagagcgaccccgagggggcgcucugguga

SEQ ID NO: 8255 - RNA, 9879 nt, Artificial Sequence
  derived and/or modified CDS sequence (opt1) from DENV-1__JN819425__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgugaagaucagcugggagcaggaggcggagcacuccggggccagccacaacauccuggucgaggugcaggacgacggcacgaugaagaucaaggacgaggagcgcgacgacacccugaccauccuccugaaggccacccugcucgccguguccggggucuaccccaugagcauccccgccacgcuguucgugugguacuucuggcagaagaagaagcagcgguccggcgugcugugggacacccccagcccgcccgaggucgagcgcgcggugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacacgggggaggagguccaggugaucgccguggagcccggcaagaacccgaagaacguccagaccacccccggcaccuucaagacgcccgagggggaggugggcgccaucgcgcucgacuucaagcccgggaccagcggcuccccgaucgugaaccgggagggcaagaucgucgggcuguacggcaacgggguggugaccaccagcggcacguacgucuccgccaucgcccaggccaaggccagccaggaggggccccugcccgagaucgaggacgagguguucaagaagcgcaaccucaccaucauggaccugcacccgggcagcggcaagacccggcgcuaccugcccgcgaucgugcgggaggccaucaagcgcaagcuccgcacccugauccuggcccccacgcgggucguggccuccgagauggcggaggcccucaaggggaugcccauccgcuaccagaccaccgccgucaagagcgagcacaccggccgggagaucgucgaccugaugugccacgccacguucaccaugcgccugcucuccccggugcgggugcccaacuacaacaugaucaucauggacgaggcccacuucaccgaccccgcgagcaucgccgcccgcggguacaucuccacccgggucggcaugggggaggccgccgcgaucuucaugacggccacgccgcccggcagcguggaggccuucccccaguccaacgccgugauccaggacgaggagcgcgacauccccgagcggagcuggaacuccggcuacgacuggaucaccgacuuccccgggaagaccgucugguucgugcccagcaucaaguccggcaacgacaucgccaacugccugcgcaagaacgggaagcgggugauccagcugagccgcaagacguucgacaccgaguaccagaagaccaagaacaacgacugggacuacgucgugaccacggacaucuccgagaugggcgcgaacuuccgggccgaccgcgugaucgacccccggcgcugccucaagcccgucauccugaaggacgggcccgagcgggugauccuggccggcccgaugcccgucaccguggccagcgcggcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgcggccaucgacggggaguaccgccugcggggcgaggcccgcaagacguucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccgcuggcgcuccgcgaguucaaggaguucgccgccggccggcgcagcgugagcggcgaccugauccuggagaucgggaagcucccccagcaccugacccugcgggcccagaacgcccucgacaaccuggucaugcugcacaacuccgagcagggcgggaaggcguaccgccacgccauggaggagcuccccgacaccaucgagacgcugaugcugcucgcccugaucgccgugcugaccggcggggugacccucuucuuccugagcggcaagggccuggggaagaccuccaucggccuccugugcgucacggcgagcuccgcccugcucuggauggccagcguggagccccacuggaucgccgccuccaucauccuggaguucuuccugauggugcuccugaucccggagcccgaccggcagcgcacgccccaggacaaccagcuggcguacgucgugaucgggcuccuguucaugauccugaccguggccgccaacgagaugggccuccuggagaccacgaagaaggaccuggggaucggcuacgucgccgccgagaaccaccagcacgcgaccaugcucgacguggaccugcacccggccagcgccuggacccuguacgccguggccaccacggucaucacccccaugaugcggcacaccaucgagaacaccacggcgaacaucucccucaccgccaucgccaaccaggccgccauccugaugggccuggacaagggguggcccaucagcaagauggacaucggcgugccccuccuggcgcuggggugcuacucccaggugaacccgcucacccugaccgccgccguccugaugcucguggcccacuacgcgaucaucggccccgggcugcaggccaaggccacgcgcgaggcccagaagcgcaccgccgcgggcaucaugaagaaccccaccguggacggcaucgucgccaucgaccuggaccccgugguguacgacgccaaguucgagaagcagcucgggcagaucaugcugcugauccucugcaccagccagauccugcugaugcggacgaccugggcccucugcgaguccaucacccuggccaccggcccgcugacgacccucugggaggggagccccggcaaguucuggaacaccaccaucgcggucuccauggccaacaucuuccgcggcagcuaccuggccggggccggccuggccuucucccucaugaagucccucgggggcgggcggcgcgggacgggcgcgcagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgugagccggggcaccgccaagcuccgcugguucgucgagcggaaccuggugaagcccgagggcaaggugaucgaccuggggugcggccgcgggggcugguccuacuacugcgcggggcugaagaaggucaccgaggugaagggcuacaccaagggcgggcccggccacgaggagccgauccccauggccaccuacggguggaaccucgugaagcugcacagcggcaaggacgucuucuucaugccgcccgagaagugcgacacgcugcucugcgacaucggggaguccagcccgaaccccaccaucgaggagggccggacccugcgcgugcugaagaugguggagcccuggcuccggggcaaccaguucugcaucaagauccugaaccccuacaugccguccgucguggagacccuggagcagaugcagcgcaagcacgggggcaugcucgugcggaacccccugagccgcaacuccacgcacgagauguacugggucagcugcgggaccggcaacaucguguccgccgugaacaugaccagccggaugcugcucaaccgcuucaccauggcccaccgcaagcccacguacgagcgggacgucgaccugggcgccgggacccgccacguggcgguggagcccgaggucgccaaccuggacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacgggguggugcgccuccugacgaagcccugggacgucauccccauggugacccagaucgccaugaccgacaccacgccguucggccagcagcggguguucaaggagaaggucgacacccgcacgccccgggcgaagcgcggcaccacgcagaucauggaggugaccgccaaguggcuguggggguuccucucccggaacaagaagccccgcaucugcacccgggaggaguucacccgcaaggugcggagcaacgccgccaucggcgccgucuucguggacgagaaccaguggaacagcgcgaaggaggccguggaggacgagcgcuucugggaccugguccaccgggagcgcgagcugcacaagcaggggaagugcgccacgugcguguacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgccgacgacaccgccggcugggacacccgcaucaccgaggacgaccugcagaacgaggcgaagaucacggacaucauggagcccgagcacgcccuccuggccaccagcaucuucaagcugaccuaccagaacaaggucgugcgcgugcagcggcccgccaagaacgggaccgucauggacgugaucucccgccgggaccagcgcggcagcggccagguggggacguacggccucaacaccuucaccaacauggagguccagcugauccggcagauggaguccgaggggaucuuccugcccagcgagcucgagaccccgaaccuggccgagcgcgcgcuggacuggcucgagaagcacggcgccgagcggcugaagcgcauggccaucuccggggacgacugcguggugaagcccaucgacgaccgguucgccacggcccugaccgcgcucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcccgcgugagccagggggccggcuggucccuccgggagaccgccugccugggcaagagcuacgcccagauguggcagcugauguacuuccaccgccgggaccuccgccuggcggccaacgccaucugcuccgccguccccguggacugggugcccaccagccggaccacguggagcauccacgcgcaccaccaguggaugaccaccgaggacaugcuguccgucuggaaccgcguguggaucgaggagaacccguggauggaggacaagacccacgugagcuccugggaggagguccccuaccucggcaagcgcgaggaccaguggugcggcagccugaucgggcugacggcccgggccaccugggccaccaacauccagguggccaucaaccaggugcgccggcucaucggcaacgagaacuaccuggacuacaugaccuccaugaagcgcuucaagaacgagagcgaccccgagggggcgcugugguga

SEQ ID NO: 8256 - RNA, 9879 nt, Artificial Sequence
  derived and/or modified CDS sequence (opt1) from DENV-1__FJ850099__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucggccugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcgcccggccagcgccuggacccucuacgccguggcgaccacggugaucacccccaugaugcggcacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccggacccugcgcguccucaagaugguggagcccuggcugaagggcaaccaguucugcaucaagauccugaaccccuacaugccguccguggucgagacccucgagcagaugcagcggaagcacgggggcaugcuggugcgcaacccccugagccggaacuccacgcacgagauguacugggugagcugcgggaccggcaacaucgucuccgccgugaacaugaccagccgcaugcuccugaaccgguucaccauggcccaccgcaagcccacguacgagcgcgacguggaccugggcgcggggacccggcacgucgccguggagcccgagguggccaaccucgacaucaucggccagcgcaucgagaacaucaagaacgagcacaaguccaccuggcacuacgacgaggacaacccguacaagaccugggccuaccacgggagcuacgaggucaagcccuccggcagcgccuccagcauggugaacggggucgugcggcugcugacgaagcccugggacgugauccccauggucacccagaucgcgaugaccgacaccacgccguucggccagcagcgcguguucaaggagaagguggacacccggacgccccgcgccaagcggggcaccacgcagaucauggaggucaccgccaaguggcucuggggguuccugucccgcaacaagaagccccggaucugcacccgcgaggaguucacccggaaggugcgcagcaacgccgccaucggcgcgguguucgucgacgagaaccaguggaacagcgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccggaucaccgaggacgaccuccagaacgaggccaagaucacggacaucauggagcccgagcacgcccugcuggccaccagcaucuucaagcucaccuaccagaacaaggugguccgcgugcagcgccccgccaagaacgggaccgugauggacgucaucucccggcgcgaccagcggggcagcggccagguggggacguacggccugaacaccuucaccaacauggaggugcagcugauccgccagauggaguccgaggggaucuuccucagcuccgagcuggagacccccaaccuggcggagcggguccucgacuggcuggagaagcacggcgccgagcgccugaagcggauggccaucagcggggacgacugcguggugaagccgaucgacgaccgcuucgccacggcccucaccgcgcugaacgacaugggcaagguccggaaggacaucccccagugggagcccuccaagggcuggaacgacuggcagcagguccccuucugcagccaccacuuccaccagcugaucaugaaggacgggcgcgagaucguggucccgugccggaaccaggacgagcucgugggccgcgcccgggugucccagggggccggcuggagccugcgcgagaccgccugccuggggaaguccuacgcccagauguggcagcucauguacuuccaccggcgcgaccugcggcuggcggccaacgccaucugcagcgccguccccguggacugggugcccaccagccgcaccacgugguccauccacgcgcaccaccaguggaugaccaccgaggacaugcucagcgucuggaaccggguguggaucgaggagaaccccuggauggaggacaagacccacguguccagcugggaggaggucccguaccugggcaagcgcgaggaccaguggugcggcucccugaucgggcucacggcccgcgccaccugggccaccaacauccagguggccaucaaccaggugcggcgccugaucggcaacgagaacuaccuggacuacaugaccagcaugaagcgguucaagaacgaguccgaccccgagggggcgcucugguga

SEQ ID NO: 8257 - RNA, 9879 nt, Artificial Sequence
  derived and/or modified CDS sequence (opt1) from DENV-1__FJ850100__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccacccaccuggcccucauggccacguucaagaugcgcccgauguucgccguggggcugcuguuccggcgccucaccagccgggaggugcugcugcucaccaucgggcugucccugauggccagcauggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccaugauccugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccguggcgagcgccgcccagcggcgcggccggaucgggcgcaaccagaacaaggagggcgaccaguacgucuacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccacccuccuguggauggccagcgucgagccccacuggaucgccgccuccaucauccuggaguucuuccucauggugcugcugaucccggagcccgaccgccagcggacgccccaggacaaccagcucgcguacguggucaucgggcugcuguucaugauccucaccguggccgccaacgagaugggccugcuggagacgaccaagaaggaccucgggaucggcuacguggccgccgagaaccaccagcacgcgaccaugcuggacgucgaccugcgcccggccagcgccuggacccucuacgccguggccacgaccgugaucacccccaugaugcggcacaccaucgagaacacgaccgcgaacaucucccugaccgccaucgccaaccaggccgccauccugaugggccucgacaagggguggcccaucagcaagauggacaucggcgucccccugcuggcgcucgggugcuacucccaggugaacccgcugacccugacggccgccgugcucaugcuggucgcccacuacgcgaucaucggccccgggcugcaggccaaggccacccgcgaggcccagaagcgcaccgccgcgggcaucaugaagaaccccaccguggacggcaucguggccaucgaccucgaccccgucguguacgacgccaaguucgagaagcagcuggggcagaucaugcugcucauccugugcacgagccagauccugcucaugcggaccaccugggcccugugcgaguccaucacccuggccacgggcccgcucaccacccugugggaggggagccccggcaaguucuggaacaccacgaucgcgguguccauggccaacaucuuccgcggcagcuaccuggccggggccggccucgccuucucccugaugaagucccucgggggcgggcggcgcgggaccggcgcgcagggggagacccucggcgagaaguggaagcggcagcugaaccagcuguccaagagcgaguucaacaccuacaagcgcagcgggaucauggaggucgaccgguccgaggccaaggagggccucaagcgcggggagacgaccaagcacgccgugagccggggcaccgccaagcugcgcugguucguggagcggaaccuggucaagcccgagggcaaggugaucgaccuggggugcggccgcgggggcugguccuacuacugcgcggggcucaagaaggugaccgaggucaagggcuacaccaagggcgggcccggccacgaggagccgauccccauggccacguacggguggaaccuggugaagcugcacagcggcaaggacguguucuucaugccgcccgagaagugcgacacccuccugugcgacaucggggaguccagcccgaaccccaccaucgaggagggccggacccugcgcguccucaagaugguggagcccuggcugaagggcaaccaguucugcaucaagauccugaaccccuacaugccguccguggucgagacgcucgagcagaugcagcggaagcacgggggcaugcuggugcgcaacccccugagccggaacuccacccacgagauguacugggugagcugcgggaccggcaacaucgucuccgccgugaacaugaccagccgcaugcuccugaaccgguucacgauggcccaccgcaagcccaccuacgagcgcgacguggaccugggcgccgggacccggcacgucgcgguggagcccgagguggccaaccucgacaucaucggccagcgcaucgagaacaucaagaacgagcacaaguccaccuggcacuacgacgaggacaacccguacaagacgugggccuaccacgggagcuacgaggucaagcccuccggcagcgccuccagcauggugaacggggugguccggcugcugaccaagcccugggacgugauccccauggucacccagaucgccaugaccgacacgaccccguucggccagcagcgcguguucaaggagaagguggacacccggacgccccgcgcgaagcggggcacgacccagaucauggaggucaccgccaaguggcucuggggguuccugucccgcaacaagaagccccggaucugcacccgcgaggaguucacgcggaaggugcgcagcaacgccgccaucggcgccguguucgucgacgagaaccaguggaacagcgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaagggcucccgggcgaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgccggcugggacacccggaucacggaggacgaccuccagaacgaggcgaagaucaccgacaucauggagcccgagcacgcccugcuggccaccagcaucuucaagcucaccuaccagaacaaggugguccgcgugcagcgccccgccaagaacgggacggugauggacgucaucucccggcgcgaccagcggggcagcggccagguggggaccuacggccugaacaccuucaccaacauggaggugcagcugauccgccagauggaguccgaggggaucuuccuccccagcgagcuggagacgccgaaccuggccgagcggguccucgacuggcuggagaagcacggcgcggagcgccugaagcggauggccaucuccggggacgacugcguggugaagcccaucgacgaccgcuucgccaccgcccucaccgcccugaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcgcgggugagccagggggccggcuggucccugcgcgagaccgccugccugggcaagagcuacgcccagauguggcagcucauguacuuccaccggcgcgaccugcggcuggccgcgaacgccaucugcuccgccguccccguggacugggugcccaccagccgcacgaccuggagcauccacgcccaccaccaguggaugaccaccgaggacaugcucuccgucuggaaccggguguggaucgaggagaacccguggauggaggacaagacgcacgugagcuccugggaggagguccccuaccugggcaagcgcgaggaccaguggugcggcagccugaucgggcucaccgcgcgcgccaccugggccaccaacauccagguggccaucaaccaggugcggcgccugaucggcaacgagaacuaccuggacuacaugacguccaugaagcgguucaagaacgagagcgaccccgagggggcccucugguga

SEQ ID NO: 8258 - RNA, 9879 nt, Artificial Sequence
  derived and/or modified CDS sequence (opt1) from DENV-1__FJ882579__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccgcaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucacgcaggggaagaagaugauccggccccagcccauggagcacaaguacuccuggaaguccuggggcaaggcgaagaucaucggcgccgacauccagaacaccaccuucaucaucgacgggcccgacaccccggagugccccgacggccagcgcgccuggaacaucugggaggucgaggacuacggguucggcaucuucacgaccaacaucuggcugaagcugcgggacuccuacacccagaugugcgaccaccgccucaugagcgccgcgaucaaggacuccaaggccgugcacgccgacaugggcuacuggaucgagagcgagaagaacgagaccuggaagcuggcccgggccuccuucaucgaggugaagacgugcaccuggcccaagagccacacccugugguccaacgggguccucgagagcgagaugaucauccccaagaucuacggcgggccgaucucccagcacaacuaccgccccggcuacuucacccagacggcggggcccuggcaccugggcaagcuggagcucgacuucgaccugugcgagggcaccaccgugguggucgacgagcacugcgggaaccggggcccgagccugcgcaccacgaccgugaccgggaagaucauccacgaguggugcugccgguccugcacccugccgccccugcgcuuccggggcgaggacgggugcugguacggcauggagauccgccccgugaaggagaaggaggagaaccugguccggagcaugguguccgccggcagcggggagguggacagcuucucccucggcauccugugcgucagcaucaugaucgaggaggugaugcgcucccgguggagccgcaagaugcugaugacggggacccucgccguguuccugcugcucaucaugggccagcugaccuggaacgaccugauccgccucugcaucauggucggggccaacgccuccgaccggaugggcaugggcaccacguaccuggcgcugauggccaccuucaagaugcgcccgauguucgccguggggcuccuguuccggcgccugaccagccgggaggugcuccugcugaccaucggccucucccuggucgccagcguggagcugcccaacucccucgaggagcugggggacggccuggccaugggcaucaugaugcucaagcugcugacggaguuccagccccaccagcucuggaccacccugcugagccucaccuucgucaagacgacccugucccuggacuacgcguggaagaccaccgccauggugcucagcaucgugucccuguucccccugugccucagcacgaccucccagaagaccaccuggcugccgguccugcucgggagcuucggcugcaagccccugaccauguuccugaucacggagaacaagaucugggggcgcaaguccuggccccucaacgagggcaucauggccaucgggaucgugagcauccugcuguccagccuccugaagaacgacgugccccuggccggcccgcucaucgcgggcgggaugcugaucgccugcuacgucaucagcggcuccagcgccgaccugcuccuggagaaggccgccgagguguccugggagcaggaggcggagcacagcggggccucccacaacauccugguggagguccaggacgacggcaccaugaagaucaaggacgaggagcgggacgacacccucaccauccugcugaaggccacgcuccuggccgugagcgggguguaccccauguccauccccgccacccuguucgucugguacuucuggcagaagaagaagcagcgcagcggcgugcucugggacacccccuccccgcccgagguggagcgggcgguccuggacgacggcaucuaccgcauccugcagcgggggcugcucggccgcagccaggugggggugggcgucuuccaggacgggguguuccacaccauguggcacgugacgcggggcgccguccugauguaccagggcaagcgccuggagcccuccugggccagcgugaagaaggaccucaucuccuacgggggcggguggcgguuccagggcagcuggaacaccggggaggaggugcaggucaucgccguggagcccggcaagaacccgaagaacgugcagaccacccccggcacguucaagacccccgagggggaggucggcgccaucgcgcuggacuucaagcccgggaccuccggcagcccgaucgugaaccgcgagggcaagaucguggggcuguacggcaacggggucgugaccacguccggcaccuacgugagcgccaucgcccaggccaaggccucccaggaggggccccuccccgagaucgaggacgaggucuucaagaagcggaaccugaccaucauggaccugcacccgggcagcggcaagacccgccgguaccuccccgcgaucgugcgcgaggccaucaagcggaagcugcgcacgcugauccucgcccccacccgcguggucgccagcgagauggcggaggcccugaaggggaugcccauccgguaccagaccaccgccgugaaguccgagcacacgggccgcgagaucguggaccugaugugccacgccaccuucaccaugcggcuccugagcccgguccgcgugcccaacuacaacaugaucaucauggacgaggcccacuucaccgaccccgcguccaucgccgcccggggguacaucagcacgcgcgugggcaugggggaggccgccgcgaucuucaugaccgccacgccgcccggcuccgucgaggccuucccccagagcaacgccgugauccaggacgaggagcgggacauccccgagcgcuccuggaacagcggcuacgacuggaucaccgacuuccccgggaagacggugugguucguccccuccaucaagagcggcaacgacaucgccaacugccugcggaagaacgggaagcgcgugauccagcucucccggaagaccuucgacaccgaguaccagaagaccaagaacaacgacugggacuacguggucacgaccgacaucagcgagaugggcgcgaacuuccgcgccgaccgggugaucgacccccgccggugccugaagcccgugauccugaaggacgggcccgagcgcgucauccucgccggcccgaugcccgugaccgucgccuccgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacgcccgagggcaucaucccggcccuguucgagcccgagcgcgagaaguccgcggccaucgacggggaguaccggcugcgcggcgaggcccggaagaccuucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccgcucgcgcugcgggaguucaaggaguucgccgccggccgccgguccgugagcggcgaccugauccucgagaucgggaagcugccccagcaccugacccuccgcgcccagaacgcccuggacaaccuggugaugcuccacaacagcgagcagggcgggaaggcguaccggcacgccauggaggagcugcccgacacgaucgagacccugaugcuccuggcccugaucgccguccucaccggcggggugacccuguucuuccuguccggcaagggccucgggaagacgagcaucggccugcugugcgugaccgcguccagcgcccuccuguggauggccuccgucgagccccacuggaucgccgccagcaucauccuggaguucuuccucauggugcugcugaucccggagcccgaccgccagcggacgccccaggacaaccagcucgcguacguggucaucgggcugcuguucaugauccucaccguggccgccaacgagaugggccugcuggagacgaccaagaaggaccucgggaucggcuacguggccgccgagaaccaccagcacgcgaccaugcuggacgucgaccugcgcccggccuccgccuggacccucuacgccguggccacgaccgugaucacccccaugaugcggcacaccaucgagaacacgaccgcgaacaucagccugaccgccaucgccaaccaggccgccauccugaugggccucgacaagggguggcccaucuccaagauggacaucggcgucccccugcuggcgcucgggugcuacagccaggugaacccgcugacccugacggccgccgugcucaugcuggucgcccacuacgcgaucaucggccccgggcugcaggccaaggccacccgcgaggcccagaagcgcaccgccgcgggcaucaugaagaaccccaccguggacggcaucguggccaucgaccucgaccccgucguguacgacgccaaguucgagaagcagcuggggcagaucaugcugcucauccugugcacgucccagauccugcucaugcggaccaccugggcccugugcgagagcaucacccuggccacgggcccgcucaccacccugugggaggggucccccggcaaguucuggaacaccacgaucgcggugagcauggccaacaucuuccgcggcuccuaccuggccggggccggccucgccuucagccugaugaagucccucgggggcgggcggcgcggcaccggcgcgcagggggagacccucggcgagaaguggaagcggcagcugaaccagcugagcaaguccgaguucaacaccuacaagcgcagcgggaucauggaggucgaccggagcgaggccaaggagggccucaagcgcggggagacgaccaagcacgccgugucccggggcaccgccaagcugcgcugguucguggagcggaaccuggucaagcccgagggcaaggugaucgaccuggggugcggccgcgggggcuggagcuacuacugcgcggggcucaagaaggugaccgaggucaagggcuacaccaagggcgggcccggccacgaggagccgauccccauggccacguacggguggaaccuggugaagcugcacuccggcaaggacguguucuucaugccgcccgagaagugcgacacccuccugugcgacaucggggagagcuccccgaaccccaccaucgaggagggccggacccugcgcguccucaagaugguggagcccuggcugaagggcaaccaguucugcaucaagauccugaaccccuacaugccgagcguggucgagacgcucgagcagaugcagcggaagcacgggggcaugcuggugcgcaacccccugucccggaacagcacccacgagauguacuggguguccugcgggaccggcaacaucgucagcgccgugaacaugaccucccgcaugcuccugaaccgguucacgauggcccaccgcaagcccaccuacgagcgcgacguggaccugggcgccgggacccggcacgucgcgguggagcccgagguggccaaccucgacaucaucggccagcgcaucgagaacaucaagaacgagcacaagagcaccuggcacuacgacgaggacaacccguacaagacgugggccuaccacggguccuacgaggucaagcccagcggcuccgccagcuccauggugaacggggucgugcggcugcugaccaagcccugggacgugauccccauggucacccagaucgccaugaccgacacgaccccguucggccagcagcgcguguucaaggagaagguggacacccggacgccccgcgcgaagcggggcacgacccagaucauggaggucaccgccaaguggcucuggggguuccugagccgcaacaagaagccccggaucugcacccgcgaggaguucacgcggaaggugcgcuccaacgccgccaucggcgccguguucgucgacgagaaccaguggaacagcgcgaaggaggccguggaggacgagcgguucugggaccuggugcaccgcgagcgggagcuccacaagcaggggaagugcgcgaccugcgucuacaacaugaugggcaagcgcgagaagaagcugggggaguucggcaaggccaagggcagccgggcgaucugguacauguggcugggggcccgcuuccucgaguucgaggcccugggcuucaugaacgaggaccacugguucucccgggagaacagccuguccgggguggagggcgaggggcuccacaagcugggcuacauccugcgcgacaucagcaagaucccgggcgggaacauguacgccgacgacaccgccggcugggacacccggaucacggaggacgaccuccagaacgaggcgaagaucaccgacaucauggagcccgagcacgcccugcuggccaccuccaucuucaagcucaccuaccagaacaaggugguccgcgugcagcgccccgccaagaacgggacggugauggacgucaucagccggcgcgaccagcggggcuccggccagguggggaccuacggccugaacaccuucaccaacauggaggugcagcugauccgccagauggagagcgaggggaucuuccuccccuccgagcuggagacgccgaaccuggccgagcggguccucgacuggcuggagaagcacggcgcggagcgccugaagcggauggccaucagcggggacgacugcguggugaagcccaucgacgaccgcuucgccaccgcccucaccgcccugaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcucgugggccgcgcgcgggugucccagggggccggcuggagccugcgcgagaccgccugccuggggaaguccuacgcccagauguggcagcucauguacuuccaccggcgcgaccugcggcuggccgcgaacgccaucugcagcgccguccccguggacugggugcccaccucccgcacgaccuggagcauccacgcccaccaccaguggaugaccaccgaggacaugcucagcgucuggaaccggguguggaucgaggagaacccguggauggaggacaagacgcacguguccagcugggaggagguccccuaccugggcaagcgcgaggaccaguggugcggcucccugaucgggcucaccgcgcgcgccaccugggccaccaacauccagguggccaucaaccaggugcggcgccugaucggcaacgagaacuaccuggacuacaugacgagcaugaagcgguucaagaacgaguccgaccccgagggggcccucugguga

SEQ ID NO: 8259 - RNA, 9879 nt, Artificial Sequence
  derived and/or modified CDS sequence (opt1) from DENV-1__JN819414__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccacccgggguucacggugaucgcccuguuccucgcguacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccuccugcuggagaaggccgcggagguguccugggagcaggaggccgagcacagcggggccucccacaacauccucguggagguccaggacgacggcacgaugaagaucaaggacgaggagcgggacgacacccugaccauccugcucaaggccacccugcuggccgugagcgggguguaccccauguccauccccgcgacccucuucgucugguacuucuggcagaagaagaagcagcgcagcggcgugcugugggacacccccuccccgcccgagguggagcgggccguccuggacgacggcaucuaccgcauccugcagcgggggcuccugggccgcagccaggugggggugggcgucuuccaggacgggguguuccacaccauguggcacgugacccggggcgccguccugauguaccagggcaagcgccucgagcccuccugggccagcgugaagaaggaccugaucuccuacgggggcggguggcgguuccagggcagcuggaacacgggggaggaggugcaggucaucgccguggagcccggcaagaacccgaagaacgugcagaccacccccggcaccuucaagacgcccgagggggaggucggcgcgaucgcccuggacuucaagcccgggaccuccggcagcccgaucgugaaccgcgagggcaagaucguggggcucuacggcaacggggucgugaccaccggcgggacguacguguccgccaucgcccaggccaaggcgagccaggagggcccccugcccgagaucgaggacgaggucuucaagaagcggaaccugaccaucauggaccuccacccgggcuccgggaagacccgccgguaccugcccgccaucgugcgcgaggccaucaagcggaagcugcgcacccucauccuggcccccacgcgcguggucgcgagcgagauggccgaggcccugaagggcaugcccauccgguaccagaccaccgccgucaagagcgagcacaccgggcgcgagaucguggaccucaugugccacgccacguucaccaugcggcugcuguccccgguccgcgugcccaacuacaacaugaucaucauggacgaggcgcacuucaccgaccccgccagcaucgccgcccggggcuacaucuccacccgcguggggaugggcgaggccgcggccaucuucaugacggccacgccgcccggcagcgucgaggccuucccccaguccaacgccgugauccaggacgaggagcgggacauccccgagcgcagcuggaacuccggguacgacuggaucaccgacuuccccggcaagaccgugugguucguccccagcaucaaguccgggaacgacaucgcgaacugccuccggaagaacggcaagcgcgugauccagcugagccggaagacguucgacaccgaguaccagaagaccaagaacaacgacugggacuacguggucaccacggacaucuccgagaugggggccaacuuccgcgccgaccgggugaucgacccccgccggugccugaagcccgugauccucaaggacggccccgagcgcgucauccuggccggcccgaugcccgugaccgucgcgagcgccgcccagcggcgcgggcggaucggccgcaaccagaacaaggagggggaccaguacguguacaugggccagccccugaacaacgacgaggaccacgcccacuggaccgaggccaagaugcuccuggacaacaucaacacccccgaggggaucaucccggcgcuguucgagcccgagcgcgagaaguccgccgccaucgacggcgaguaccggcuccgcggcgaggcccggaagacguucguggagcugaugcgccgcggggaccugcccgucuggcucagcuacaagguggccuccgagggcuuccaguacagcgaccgccgguggugcuucgacggggagcgcaacaaccaggugcuggaggagaacauggacgucgagaucuggaccaaggagggcgagcggaagaagcugcgcccccgguggcucgacgcgcgcaccuacuccgacccgcuggcccugcgggaguucaaggaguucgccgccggccgccggagcguguccggggaccucauccuggagaucggcaagcugccccagcaccucacccugcgcgcccagaacgcgcuggacaaccucgugaugcugcacaacagcgagcagggcgggaaggccuaccggcacgccauggaggagcugcccgacaccaucgagacgcucaugcugcuggcccucaucgcgguccugaccgggggcgugacccuguucuuccucagcggcaaggggcugggcaagaccuccaucgggcugcucugcgugacggccagcuccgcccugcuguggauggccagcgucgagccccacuggaucgccgcguccaucauccucgaguucuuccugauggugcugcucaucccggagcccgaccgccagcggacgccccaggacaaccagcuggccuacguggucaucggccuccucuucaugauccugaccguggccgccaacgagauggggcugcucgagaccacgaagaaggaccugggcaucggcuacguggccgcggagaaccaccagcacgccaccaugcuggacgucgaccuccgcccggccagcgccuggacccuguacgccguggcgaccacggugaucacccccaugaugcggcacaccaucgagaacaccacggccaacaucucccugaccgccaucgccaaccaggccgcgauccucauggggcuggacaagggcuggcccaucagcaagauggacaucggggucccccugcucgcccugggcugcuacucccaggugaacccgcugacccucaccgccgccgugcugaugcuggucgcgcacuacgccaucaucgggcccggccuccaggccaaggccacgcgcgaggcccagaagcgcaccgcggccggcaucaugaagaaccccaccguggacgggaucguggccaucgaccuggaccccgucguguacgacgccaaguucgagaagcagcugggccagaucaugcuccugauccugugcaccagccagauccuccugaugcggacgaccugggcccugugcgaguccaucacccucgcgaccgggccgcugacgacccugugggagggcagccccggcaaguucuggaacaccaccaucgccguguccauggccaacaucuuccgcgggagcuaccucgccggcgccgggcuggcguucucccugaugaagucccucggcgggggccggcgcggcacgggggcccagggcgagacccugggggagaaguggaagcggcagcugaaccagcucuccaagagcgaguucaacaccuacaagcgcuccggcaucauggaggucgaccggagcgaggccaaggaggggcugaagcgcggcgagaccacgaagcacgccgugagccggggcaccgcgaagcugcgcugguucguggagcggaaccuggucaagcccgaggggaaggugaucgaccucggcugcgggcgcggcgggugguccuacuacugcgccggccugaagaaggugaccgaggucaagggcuacaccaagggcgggcccgggcacgaggagccgauccccauggccaccuacggcuggaaccuggugaagcuccacagcgggaaggacguguucuucaugccgcccgagaagugcgacacgcugcugugcgacaucggcgaguccagcccgaaccccaccaucgaggagggccggacccuccgcguccugaagaugguggagcccuggcugaaggggaaccaguucugcaucaagauccucaaccccuacaugccguccguggucgagacccuggagcagaugcagcggaagcacggcgggaugcuggugcgcaacccccucagccggaacuccacgcacgagauguacugggugagcugcggcaccggcaacaucgucuccgccgugaacaugaccagccgcaugcugcugaaccgguucaccauggcccaccgcaagcccacguacgagcgcgacguggaccucggggcgggcacccggcacgucgccguggagcccgagguggccaaccuggacaucaucgggcagcgcaucgagaacaucaagaacgagcacaaguccaccuggcacuacgacgaggacaacccguacaagaccugggccuaccacggcagcuacgaggucaagcccuccgggagcgccuccagcauggugaacggcgucgugcggcugcucacgaagcccugggacgugauccccauggucacccagaucgcgaugaccgacaccacgccguucggccagcagcgcguguucaaggagaagguggacacccggacgccccgcgccaagcgggggaccacgcagaucauggaggucaccgccaaguggcuguggggcuuccugucccgcaacaagaagccccggaucugcacccgcgaggaguucacccggaaggugcgcagcaacgccgccaucggggcgguguucgucgacgagaaccaguggaacacggccaaggaggccguggaggacgagcgguucugggaccucgugcaccgcgagcgggagcugcacaagcagggcaagugcgcgaccugcgucuacaacaugauggggaagcgcgagaagaagcugggcgaguucggcaaggcgaaggggucccgggccaucugguacauguggcucggcgcccgcuuccuggaguucgaggcccugggguucaugaacgaggaccacugguucagccgggagaacagccucuccggcguggagggggagggccugcacaagcugggcuacauccuccgcgacaucagcaagauccccggcgggaacauguacgccgacgacaccgcggggugggacacccggaucacggaggacgaccugcagaacgaggccaagaucaccgacaucauggagcccgagcacgcccugcucgccaccuccaucuucaagcugaccuaccagaacaaggugguccgcgugcagcgccccgccaagaacgggacggugauggacgucaucagccggcgcgaccagcggggcuccggccaggugggcaccuacgggcugaacaccuucaccaacauggaggugcagcucauccgccagauggagagcgagggcaucuuccugcccuccgagcuggagacgccgaaccucgcggagcgggcccuggacuggcuggagaagcacggggccgagcgccucaagcggauggccaucagcggcgacgacugcgucgugaagcccaucgacgaccgcuucgccaccgcgcugaccgcccugaacgacaugggcaaggugcggaaggacaucccccagugggagcccuccaagggguggaacgacuggcagcaggucccguucugcagccaccacuuccaccagcucaucaugaaggacggccgcgagaucguggugcccugccggaaccaggacgagcuggucgggcgcgcccgggugucccagggcgccggguggagccugcgcgagaccgccugccucggcaaguccuacgcgcagauguggcagcugauguacuuccaccggcgcgaccugcggcucgccgccaacgccaucugcagcgcggugcccgucgacugggugcccaccucccgcacgaccuggagcauccacgcccaccaccaguggaugaccaccgaggacaugcuguccguguggaaccgggucuggaucgaggagaacccguggauggaggacaagacgcacgugagcagcugggaggaggugcccuaccugggcaagcgcgaggaccaguggugcgggucccucaucggccugaccgcccgcgccaccugggccaccaacauccaggucgcgaucaaccaggugcggcgccugaucgggaacgagaacuaccucgacuacaugacgagcaugaagcgguucaagaacgaguccgaccccgagggcgcccugugguga

SEQ ID NO: 8260 - RNA, 9879 nt, Artificial Sequence
  derived and/or modified CDS sequence (opt1) from DENV-1__FJ873810__SS-prME
agcgugaccaugcugcucaugcugcugcccaccgcccucgccuuccaccugaccacccgcggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgucggccuggggcucgagacccgcaccgagaccuggaugagcuccgagggcgccuggaagcagauccagcggguggagaccugggcccugcgccaccccggguucacggugaucgccuucuuccuggcccacgcgaucggcaccagcaucacccagaaggggaucaucuucauccuccugaugcuggugacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcccgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagccccaccagcucuggacgacccugcugagccucaccuucgugaagaccacgcugucccuggacuacgcguggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccuggccggcccgcucaucgcgggcgggaugcugaucgccugcuacgugaucagcggcuccagcgccgaccugucccucgagaaggccgccgaggucagcugggagcaggaggcggagcacuccggggccagccacaacauccugguggaggugcaggacgacggcacgaugaagaucaaggacgaggagcgcgacgacacccugaccauccuccugaaggccacccugcucgccgucuccgggguguaccccaugagcauccccgccacgcuguucgugugguacuucuggcagaagaagaagcagcgguccggcguccugugggacacccccagcccgcccgagguggagcgcgcggugcucgacgacggcaucuaccggauccugcagcgcgggcugcugggccggucccaggucggggugggcguguuccaggacggggucuuccacaccauguggcacgugacccgcggcgccgugcucauguaccagggcaagcggcuggagcccagcugggccuccgucaagaaggaccugaucagcuacgggggcggguggcgcuuccagggcuccuggaacacgggggaggagguccaggugaucgccgucgagcccggcaagaacccgaagaacgugcagaccacccccggcaccuucaagacgcccgagggggaggugggcgccaucgcgcucgacuucaagcccgggaccagcggcuccccgaucgucaaccgggagggcaagaucguggggcuguacggcaacgggguggucaccaccagcggcacguacguguccgccaucgcccaggccaaggccagccaggaggggccccugcccgagaucgaggacgagguguucaagaagcgcaaccucaccaucauggaccugcacccgggcagcggcaagacccggcgcuaccugcccgcgaucguccgggaggccaucaagcgcaagcuccgcacccugauccuggcccccacgcgggugguggccuccgagauggcggaggcccucaaggggaugcccauccgcuaccagaccaccgccgucaagagcgagcacaccggccgggagaucguggaccugaugugccacgccacguucaccaugcgccugcucuccccggugcggguccccaacuacaacaugaucaucauggacgaggcccacuucaccgaccccgcgagcaucgccgcccgcggguacaucuccacccgggugggcaugggggaggccgccgcgaucuucaugacggccacgccgcccggcagcguggaggccuucccccaguccaacgccgucauccaggacgaggagcgcgacauccccgagcggagcuggaacuccggcuacgacuggaucaccgacuuccccgggaagaccgugugguucgugcccagcaucaaguccggcaacgacaucgccaacugccugcgcaagaacgggaagcgggucauccagcugagccgcaagacguucgacaccgaguaccagaagaccaagaacaacgacugggacuacguggugaccacggacaucuccgagaugggcgcgaacuuccgggccgaccgcgucaucgacccccggcgcugccucaagcccgugauccugaaggacgggcccgagcgggucauccuggccggcccgaugcccgugaccguggccagcgcggcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgcggccaucgacggggaguaccgccugcggggcgaggcccgcaagacguucguggagcugaugcggcgcggcgaccuccccguguggcugagcuacaaggucgccuccgagggguuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccgcuggcgcuccgcgaguucaaggaguucgccgccggccggcgcagcgucagcggcgaccugauccuggagaucgggaagcucccccagcaccugacccugcgggcccagaacgcccucgacaaccuggugaugcugcacaacuccgagcagggcgggaaggcguaccgccacgccauggaggagcuccccgacaccaucgagacgcugaugcugcucgcccugaucgccgugcugaccggcggggucacccucuucuuccugagcggcaagggccuggggaagaccuccaucggccuccugugcgugacggcgagcuccgcccugcucuggauggccagcguggagccccacuggaucgccgccuccaucauccuggaguucuuccugaugguccuccugaucccggagcccgaccggcagcgcacgccccaggacaaccagcuggcguacguggugaucgggcuccuguucaugauccugaccgucgccgccaacgagaugggccuccuggagaccacgaagaaggaccuggggaucggcuacguggccgccgagaaccaccagcacgcgaccaugcucgacguggaccugcacccggccagcgccuggacccuguacgccgucgccaccacggugaucacccccaugaugcggcacaccaucgagaacaccacggcgaacaucucccucaccgccaucgccaaccaggccgccauccugaugggccuggacaagggguggcccaucagcaagauggacaucggcgugccccuccuggcgcuggggugcuacucccaggucaacccgcucacccugaccgccgccgugcugaugcucguggcccacuacgcgaucaucggccccgggcugcaggccaaggccacgcgcgaggcccagaagcgcaccgccgcgggcaucaugaagaaccccaccgucgacggcaucguggccaucgaccuggaccccguggucuacgacgccaaguucgagaagcagcucgggcagaucaugcugcugauccucugcaccagccagauccugcugaugcggacgaccugggcccucugcgaguccaucacccuggccaccggcccgcugacgacccucugggaggggagccccggcaaguucuggaacaccaccaucgcgguguccauggccaacaucuuccgcggcagcuaccuggccggggccggccuggccuucucccucaugaagucccucgggggcgggcggcgcgggacgggcgcgcagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgucagccggggcaccgccaagcuccgcugguucguggagcggaaccuggugaagcccgagggcaaggucaucgaccuggggugcggccgcgggggcugguccuacuacugcgcggggcugaagaaggugaccgaggugaagggcuacaccaagggcgggcccggccacgaggagccgauccccauggccaccuacggguggaaccucgucaagcugcacagcggcaaggacguguucuucaugccgcccgagaagugcgacacgcugcucugcgacaucggggaguccagcccgaaccccaccaucgaggagggccggacccugcgcgugcugaagauggucgagcccuggcuccggggcaaccaguucugcaucaagauccugaaccccuacaugccguccgugguggagacccuggagcagaugcagcgcaagcacgggggcaugcucguccggaacccccugagccgcaacuccacgcacgagauguacugggugagcugcgggaccggcaacaucguguccgccgucaacaugaccagccggaugcugcucaaccgcuucaccauggcccaccgcaagcccacguacgagcgggacguggaccugggcgccgggacccgccacguggcggucgagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccuccugacgaagcccugggacgugauccccauggugacccagaucgccaugaccgacaccacgccguucggccagcagcgggucuucaaggagaagguggacacccgcacgccccgggcgaagcgcggcaccacgcagaucauggaggugaccgccaaguggcuguggggguuccucucccggaacaagaagccccgcaucugcacccgggaggaguucacccgcaagguccggagcaacgccgccaucggcgccguguucguggacgagaaccaguggaacagcgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcggggucgagggcgaggggcugcacaagcucggcuacauccugcgggacaucuccaagaucccgggcgggaacauguacgccgacgacaccgccggcugggacacccgcaucaccgaggacgaccugcagaacgaggcgaagaucacggacaucauggagcccgagcacgcccuccuggccaccagcaucuucaagcugaccuaccagaacaagguggugcgcguccagcggcccgccaagaacgggaccgugauggacgugaucucccgccgggaccagcgcggcagcggccaggucgggacguacggccucaacaccuucaccaacauggaggugcagcugauccggcagauggaguccgaggggaucuuccugcccagcgagcucgagaccccgaaccuggccgagcgcgcgcuggacuggcucgagaagcacggcgccgagcggcugaagcgcauggccaucuccggggacgacugcguggucaagcccaucgacgaccgguucgccacggcccugaccgcgcucaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcuggugggccgggcccgcgucagccagggggccggcuggucccuccgggagaccgccugccugggcaagagcuacgcccagauguggcagcugauguacuuccaccgccgggaccuccgccuggcggccaacgccaucugcuccgccgugcccguggacuggguccccaccagccggaccacguggagcauccacgcgcaccaccaguggaugaccaccgaggacaugcuguccguguggaaccgcguguggaucgaggagaacccguggauggaggacaagacccacgucagcuccugggaggaggugcccuaccucggcaagcgcgaggaccaguggugcggcagccugaucgggcugacggcccgggccaccugggccaccaacauccagguggccaucaaccagguccgccggcucaucggcaacgagaacuaccuggacuacaugaccuccaugaagcgcuucaagaacgagagcgaccccgagggggcgcugugguga

SEQ ID NO: 8261 - RNA, 9879 nt, Artificial Sequence
  derived and/or modified CDS sequence (opt1) from DENV-1__FJ850103__SS-prME
agcgugaccaugcugcucaugcugcugcccaccgcccucgccuuccaccugacgacccgcggcggggagccgcacaugaucgucuccaagcaggagcggggcaagagccugcucuucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacacgugggucaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccacccgggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucaccccccaggcccccacgagcgagauccagcugaccgacuacggggcccugacccucgacugcuccccccgcaccggccuggacuucaacgagaugguccugcucacgaugaaggagaagagcuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccccccuucggggagagcuacaucguggucggcgccggcgagaaggcgcucaagcuguccugguucaagcgcgggagcuccaucggcaagauguucgaggccaccgcccggggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaagagcuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcaucuggcccaagagccacacgcugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcaccacgguggucguggacgagcacugcgggaaccgcggcccgagccugcggaccaccaccgugacggggaagaucauccacgaguggugcugccgcuccugcacccuccccccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacccucgccgucuuccugcugcucaucaugggccagcugacguggaacgaccugauccggcucugcaucauggugggggccaacgcguccgaccgcaugggcaugggcaccaccuaccuggcccugauggccaccuucaagaugcggccgauguucgccguggggcuccuguuccgccggcugacgagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggaccacgcugcugagccucaccuucgugaagaccacccugucccuggacuacgccuggaagacgaccgccauggugcucagcaucgucucccuguucccccugugccucagcaccaccucccagaagacgaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaaggccgcggaggugagcugggagcaggaggccgagcacuccggggccagccacaacauccuggucgaggugcaggacgacggcaccaugaagaucaaggacgaggagcgcgacgacacgcugaccauccuccugaaggccacccugcucgccguguccggggucuaccccaugagcauccccgcgacccuguucgugugguacuucuggcagaagaagaagcagcgguccggcgugcugugggacacgcccagcccgcccgaggucgagcgcgccgugcucgacgacggcaucuaccggauccugcagcgcgggcugcugggccggucccaggugggggucggcguguuccaggacgggguguuccacaccauguggcacgucacccgcggcgccgugcucauguaccagggcaagcggcuggagcccagcugggccuccgugaagaaggaccugaucagcuacgggggcggguggcgcuuccagggcuccuggaacaccggggaggagguccaggugaucgccguggagcccggcaagaacccgaagaacguccagacgacccccggcaccuucaagacccccgagggggaggugggcgcgaucgcccucgacuucaagcccgggacgagcggcuccccgaucgugaaccgggagggcaagaucgucgggcuguacggcaacgggguggugaccaccagcggcaccuacgucuccgccaucgcccaggccaaggcgagccaggaggggccccugcccgagaucgaggacgagguguucaagaagcgcaaccucacgaucauggaccugcacccgggcagcggcaagacccggcgcuaccugcccgccaucgugcgggaguccaucaagcgcaagcuccgcacccugauccuggcccccacccgggucguggccagcgagauggcggaggcccucaaggggaugcccauccgcuaccagacgaccgccgugaaguccgagcacaccggccgggagaucgucgaccugaugugccacgccaccuucacgaugcgccugcucagcccggugcgggugcccaacuacaacaugaucaucauggacgaggcccacuucaccgaccccgcguccaucgccgcccgcggguacaucagcacccgggucggcaugggggaggccgccgcgaucuucaugaccgccacgcccccgggcuccguggaggccuucccccagagcaacgccgugauccaggacgaggagcgcgacauccccgagcgguccuggaacagcggcuacgacuggaucaccgacuuccccgggaagaccgucugguucgugccguccaucaagagcggcaacgacaucgccaacugccugcgcaagaacgggaagcgggugauccagcugucccgcaagaccuucgacacggaguaccagaagaccaagaacaacgacugggacuacgucgugaccaccgacaucagcgagaugggcgcgaacuuccgggccgaccgcgugaucgacccccggcgcugccucaagcccgucauccugaaggacgggcccgagcgggugauccuggccggcccgaugcccgucacgguggccuccgcggcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaagagcgcggccaucgacggggaguaccgccugcggggcgaggcccgcaagaccuucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggacgaaggagggggagcgcaagaagcuccggccccgcuggcuggacgcccggaccuacagcgacccgcuggcgcuccgcgaguucaaggaguucgccgccggccggcgcagcguguccggcgaccugauccuggagaucgggaagcucccccagcaccugacccugcgggcccagaacgcccucgacaaccuggucaugcugcacaacagcgagcagggcgggaaggcguaccgccacgccauggaggagcuccccgacaccaucgagacccugaugcugcucgcccugaucgccgugcugacgggcggggugacccucuucuuccuguccggcaagggccuggggaagaccagcaucggccuccugugcgucaccgcguccagcgcccugcucuggauggccuccguggagccccacuggaucgccgccagcaucauccuggaguucuuccugauggugcuccugaucccggagcccgaccggcagcgcacgccccaggacaaccagcuggcguacgucgugaucgggcuccuguucaugauccugaccguggccgccaacgagaugggccuccuggagaccaccaagaaggaccuggggaucggcuacgucgccgccgagaaccaccagcacgcgacgaugcucgacguggaccugcacccggccuccgccuggacccuguacgccguggccaccaccgucaucacgcccaugaugcggcacaccaucgagaacaccaccgcgaacaucagccucacggccaucgccaaccaggccgccauccugaugggccuggacaagggguggcccaucuccaagauggacaucggcgugccccuccuggcgcuggggugcuacagccaggugaacccgcucacccugaccgccgccguccugaugcucguggcccacuacgcgaucaucggccccgggcugcaggccaaggccacccgcgaggcccagaagcgcacggccgcgggcaucaugaagaaccccaccguggacggcaucgucgccaucgaccuggaccccgugguguacgacgccaaguucgagaagcagcucgggcagaucaugcugcugauccucugcaccucccagauccugcugaugcggaccacgugggcccucugcgagagcaucacccuggccaccggcccgcugaccacgcucugggaggggucccccggcaaguucuggaacaccaccaucgcggucagcauggccaacaucuuccgcggcuccuaccuggccggggccggccuggccuucagccucaugaagucccuggggggcgggcggcgcggcaccggcgcgcagggggagacgcugggcgagaaguggaagcggcagcucaaccagcugagcaagagcgaguucaacaccuacaagcgcuccgggaucauggagguggaccggagcgaggccaaggagggccugaagcgcggggagaccaccaagcacgccgugucccggggcacggccaagcuccgcugguucgucgagcggaaccuggugaagcccgagggcaaggugaucgaccuggggugcggccgcgggggcuggagcuacuacugcgcggggcugaagaaggucaccgaggugaagggcuacaccaagggcgggcccggccacgaggagccgauccccauggccaccuacggguggaaccucgugaagcugcacuccggcaaggacgucuucuucaugccccccgagaagugcgacacccugcucugcgacaucggggagagcuccccgaaccccacgaucgaggagggccggacccugcgcgugcugaagaugguggagcccuggcuccggggcaaccaguucugcaucaagauccugaaccccuacaugccgagcgucguggagacccuggagcagaugcagcgcaagcacgggggcaugcucgugcggaacccccugucccgcaacagcacccacgagauguacugggucuccugcgggacgggcaacaucgugagcgccgugaacaugaccucccggaugcugcucaaccgcuucaccauggcccaccgcaagcccaccuacgagcgggacgucgaccugggcgccgggacgcgccacguggcgguggagcccgaggucgccaaccuggacaucaucggccagcggaucgagaacaucaagaacgagcacaagagcaccuggcacuacgacgaggacaacccguacaagaccugggccuaccacggguccuacgaggugaagcccagcggcuccgccagcuccauggucaacgggguggugaagcuccugaccaagcccugggacgucauccccauggugacgcagaucgccaugaccgacaccaccccguucggccagcagcgcguguucaaggagaaggucgacacgcggaccccccgcgcgaagcggggcaccacccagaucauggaggugacggccaaguggcuguggggguuccucagccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgccaccugcguguacaacaugaugggcaagcgcgagaagaagcucggggaguucggcaaggccaagggcagccgggcgaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgccgacgacacggccggcugggacacccggaucaccgaggacgaccugcagaacgaggcgaagaucaccgacaucauggagcccgagcacgcccuccuggccacguccaucuucaagcugaccuaccagaacaaggucgugcgcgugcagcgccccgccaagaacgggaccgucauggacgugaucagccggcgcgaccagcggggcuccggccagguggggaccuacggccucaacacguucaccaacauggagguccagcugauccgccagauggagagcgaggggaucuuccugcccuccgagcucgagaccccgaaccuggccgagcgggcgcuggacuggcucgagaagcacggcgccgagcgccugaagcggauggccaucagcggggacgacugcguggugaagcccaucgacgaccgcuucgccaccgcccugacggcgcucaacgacaugggcaagguccggaaggacaucccccagugggagcccuccaagggcuggaacgacuggcagcaggugccguucugcagccaccacuuccaccagcugaucaugaaggacgggcgcgagaucgugguccccugccggaaccaggacgagcuggugggccgcgcccgggugucccagggggccggcuggagccuccgcgagaccgccugccuggggaaguccuacgcccagauguggcagcugauguacuuccaccggcgcgaccuccggcuggcggccaacgccaucugcagcgccguccccguggacugggugcccaccagccgcaccaccugguccauccacgcgcaccaccaguggaugacgaccgaggacaugcugagcgucuggaaccggguguggaucgaggagaacccguggauggaggacaagacccacguguccagcugggaggagguccccuaccucggcaagcgcgaggaccaguggugcggcucccugaucgggcugaccgcccgcgccacgugggccaccaacauccagguggccaucaaccaggugcggcgccucaucggcaacgagaacuaccuggacuacaugaccagcaugaagcgguucaagaacgaguccgaccccgagggggcgcugugguga

SEQ ID NO: 8262 - RNA, 9879 nt, Artificial Sequence
  derived and/or modified CDS sequence (opt1) from DENV-1__FJ850104__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgugaccgacaccugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagcggguggagaccugggcccugcgccaccccggguucacggugaucgcccuguuccucgcccacgcgaucggcaccagcaucacccagaaggggaucaucuucauccugcugaugcucgugacccccuccauggccaugcggugcgugggcaucggcaaccgcgacuucguggaggggcugagcggcgccacgugggucgacguggugcuggagcacggguccugcgucaccaccauggccaagaacaagcccacccucgacaucgagcugcugaagacggaggugaccaaccccgccgugcuccggaagcugugcaucgaggcgaagaucagcaacaccaccacggacucccgcugcccgacccagggcgaggccacccuggucgaggagcaggacgccaacuucgugugccggcgcaccuucguggaccggggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccgcaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcucaucacggccaacccgaucgugaccgacaaggagaagcccgugaacaucgagaccgagccgcccuucggggagagcuacaucgucgugggcgccggcgagaaggcccugaagcuguccugguucaagaaggggagcuccaucggcaagauguucgaggcgaccgcccgcggggcccggcgcauggccauccucggcgacacggccugggacuucgggagcaucggcggcguguucaccuccgucgggaagcuggugcaccagguguucggcaccgcguacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccuggcccaggggaagaagaugauccggccccagcccauggagcacaaguacuccuggaaguccuggggcaaggcgaagaucaucggcgccgacauccagaacacgaccuucaucaucgacgggcccgacaccccggagugccccgacggccagcgcgccuggaacaucugggagguggaggacuacggguucggcaucuucaccacgaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagaccugcacguggcccaagagccacacccucugguccaacggggugcuggagagcgagaugaucauccccaagaucuacggcgggccgaucucccagcacaaccaccgccccggcuacuucacccagaccgcggggcccuggcaccugggcaagcucgagcuggacuucgaccugugcgagggcacgaccguggucguggacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugaccgggacgcuggccgucuuccugcuccugaucaugggccagcugaccuggaacgaccucauccgccugugcaucauggugggggccaacgccuccgaccggaugggcaugggcaccaccuaccuggcccucauggccacguucaagaugcgcccgauguucgccguggggcugcuguuccggcgccucaccagccgggagguccugcugcucaccaucgggcugucccugguggccagcgucgagcuccccaacucccuggaggagcugggggacggccucgccaugggcaucaugaugcugaagcugcucaccgaguuccagccccaccagcuguggacgacccugcucagccugaccuucgugaagaccacgcugucccucgacuacgcguggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgucccccucgccggcccgcugaucgcgggcgggaugcugaucgccugcuacgugaucagcggcuccagcgccgaccucucccuggagaaggccgccgaggugagcugggagcaggaggcggagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgccacgcuguucgugugguacuucuggcagaagaagaagcagcgcuccggcgugcucugggacacccccagcccgcccgaggucgagcgggcggugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgccaucgcgcuggacuucaagcccgggaccagcggcuccccgaucgugaaccgcgagggcaagaucgucgggcuguacggcaacgggguggugaccaccagcggcacguacgucuccgccaucgcccaggccaaggccagccaggaggggccccuccccgagaucgaggacgagguguucaagaagcggaaccugaccaucauggaccugcacccgggcagcggcaagacccgccgguaccuccccgcgaucgugcgcgaggccaucaagcggaagcugcgcacccugauccucgcccccacgcgcgucguggccuccgagauggcggaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcccacuucaccgaccccgcgagcaucgccgcccggggguacaucuccacccgcgucggcaugggggaggccgccgcgaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgccaacugccugcggaagaacgggaagcgcgugauccagcucagccggaagacguucgacaccgaguaccagaagaccaagaacaacgacugggacuacgucgugaccacggacaucuccgagaugggcgcgaacuuccgcgccgaccgggugaucgacccccgccggugccugaagcccgucauccugaaggacgggcccgagcgcgugauccucgccggcccgaugcccgucaccguggccagcgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcccuguucgagcccgagcgcgagaaguccgcggccaucgacggggaguaccggcugcgcggcgaggcccggaagacguucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccgcucgcgcugcgggaguucaaggaguucgccgccggccgccggagcgugagcggcgaccugauccucgagaucgggaagcugccccagcaccugacccuccgcgcccagaacgcccuggacaaccuggucaugcuccacaacuccgagcagggcgggaaggcguaccggcacgccauggaggagcugcccgacaccaucgagacgcugaugcuccuggcccugaucgccgugcucaccggcggggugacccuguucuuccugagcggcaagggccucgggaagaccuccaucggccugcugugcgucacggcgagcuccgcccuccuguggauggccagcguggagccccacuggaucgccgccuccaucauccuggaguucuuccucauggugcugcugaucccggagcccgaccgccagcggacgccccaggacaaccagcucgcguacgucgugaucgggcugcuguucaugauccucaccguggccgccaacgagaugggccugcuggagaccacgaagaaggaccucgggaucggcuacgucgccgccgagaaccaccagcacgcgaccaugcuggacguggaccugcgcccggccagcgccuggacccucuacgccguggccaccacggucaucacccccaugaugcggcacaccaucgagaacaccacggcgaacaucucccugaccgccaucgccaaccaggccgccauccugaugggccucgacaagggguggcccaucagcaagauggacaucggcgugccccugcuggcgcucgggugcuacucccaggugaacccgcugacccugaccgccgccguccucaugcugguggcccacuacgcgaucaucggccccgggcugcaggccaaggccacgcgcgaggcccagaagcgcaccgccgcgggcaucaugaagaaccccaccguggacggcaucgucgccaucgaccucgaccccgugguguacgacgccaaguucgagaagcagcuggggcagaucaugcugcucauccugugcaccagccagauccugcucaugcggacgaccugggcccugugcgaguccaucacccuggccaccggcccgcucacgacccugugggaggggagccccggcaaguucuggaacaccaccaucgcggucuccauggccaacaucuuccgcggcagcuaccuggccggggccggccucgccuucucccugaugaagucccucgggggcgggcggcgcgggacgggcgcgcagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgugagccggggcaccgccaagcugcgcugguucgucgagcggaaccuggugaagcccgagggcaaggugaucgaccuggggugcggccgcgggggcugguccuacuacugcgcggggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccggacccugcgcgugcucaagaugguggagcccuggcugcggggcaaccaguucugcaucaagauccugaaccccuacaugccguccgucguggagacccucgagcagaugcagcgcaagcacgggggcaugcuggugcggaacccccugagccgcaacuccacgcacgagauguacugggucagcugcgggaccggcaacaucguguccgccgugaacaugaccagccggaugcuccugaaccgcuucaccauggcccaccgcaagcccacguacgagcgggacgucgaccugggcgccgggacccgccacguggcgguggagcccgaggaggccaaccucgacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggucgugcgccugcugacgaagcccugggacgugauccccauggucacccagaucgccaugaccgacaccacgccguucggccagcagcggguguucaaggagaagguggacacccgcacgccccgggcgaagcgcggcaccacgcagaucauggaggucaccgccaaguggcucuggggguuccugucccggaacaagaagccccgcaucugcacccgggaggaguucacccgcaaggugcggagcaacgccgccaucggcgccguguucgucgacgagaaccaguggaacagcgcgaaggaggccguggaggacgagcgcuucugggaccuggugcaccgggagcgcgagcuccacaagcaggggaagugcgccacgugcgucuacaacaugaugggcaagcgggagaagaagcugggggaguucggcaaggccaagggcucccgcgcgaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacaccgccggcugggacacccgcaucaccgaggacgaccuccagaacgaggcgaagaucacggacaucauggagcccgagcacgcccugcuggccaccagcaucuucaagcucaccuaccagaacaaggugguccgcgugcagcggcccgccaagaacgggaccgugauggacgucaucucccgccgggaccagcgcggcagcggccagguggggacguacggccugaacaccuucaccaacauggaggugcagcugauccggcagauggaguccgaggggaucuuccuccccagcgagcuggagaccccgaaccuggccgagcgcguccucgacuggcuggagaagcacggcgcggagcggcugaagcgcauggccaucuccggggacgacugcguggugaagcccaucgacgaccgguucgccacggcccucaccgcccugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcgcgcgugagccagggggccggcuggucccugcgggagaccgccugccugggcaagagcuacgcccagauguggcagcucauguacuuccaccgccgggaccugcgccuggccgcgaacgccaucugcuccgccguccccguggacugggugcccaccagccggaccacguggagcauccacgcccaccaccaguggaugaccaccgaggacaugcucuccgucuggaaccgcguguggaucgaggagaacccguggauggaggacaagacccacgugagcuccugggaggagguccccuaccugggcaagcgcgaggaccaguggugcggcagccugaucgggcucacggcgcgggccaccugggccaccaacauccagguggccaucaaccaggugcgccggcugaucggcaacgagaacuaccuggacuacaugaccuccaugaagcgcuucaagaacgagagcgaccccgagggggcccucugguga

SEQ ID NO: 8263 - RNA, 9879 nt, Artificial Sequence
  derived and/or modified CDS sequence (opt1) from DENV-1__JN819405__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccacccaccuggcccucauggccacguucaagaugcgcccgauguucgccguggggcugcuguuccggcgccucaccagccgggaggugcugcugcucaccaucggccugucccugauggccagcauggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccaugauccugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagaccacgggccgcgagaucguggaccugaugugccacgccaccuucaccaugcggcuccuguccccgguccgcgugcccaacuacaacaugaucaucauggacgaggcgcacuucaccgaccccgccagcaucgccgcccggggguacaucuccacgcgcgugggcaugggggaggccgcggccaucuucaugaccgccacgccgcccggcagcgucgaggccuucccccaguccaacgccgugauccaggacgaggagcgggacauccccgagcgcagcuggaacuccggcuacgacuggaucaccgacuuccccgggaagacggugugguucguccccagcaucaaguccggcaacgacaucgcgaacugccugcggaagaacgggaagcgcgugauccagcucagccggaagaccuucgacaccgaguaccagaagaccaagaacaacgacugggacuacguggucacgaccgacaucuccgagaugggcgccaacuuccgcgccgaccgggugaucgacccccgccggugccugaagcccgugauccugaaggacgggcccgagcgcgucauccucgccggcccgaugcccgugaccguggcgagcgccgcccagcggcgcggccggaucgggcgcaaccagaacaaggagggcgaccaguacgucuacauggggcagccccugaacaacgacgaggaccacgcccacuggaccgaggccaagaugcugcucgacaacaucaacacgcccgagggcaucaucccggcgcuguucgagcccgagcgcgagaaguccgccgccaucgacggggaguaccggcugcgcggcgaggcccggaagaccuucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacacgaucgagacccugaugcuccuggcccugaucgcgguccucaccggcggggugacccuguucuuccugagcggcaagggccucgggaagacguccaucggccugcugugcgugaccgccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagacgaccaagaaggaccucgggaucggcuacguggccgcggagaaccaccagcacgccaccaugcuggacgucgaccugcgcccggccagcgccuggacccucuacgccguggcgacgaccgugaucacccccaugaugcggcacaccaucgagaacacgaccgccaacaucucccugaccgccaucgccaaccaggccgcgauccugaugggccucgacaagggguggcccaucagcaagauggacaucggcgucccccugcuggcccucgggugcuacucccaggugaacccgcugacccugacggccgccgugcucaugcuggucgcgcacuacgccaucaucggccccgggcugcaggccaaggccacccgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcacgagccagauccugcucaugcggaccaccugggcccugugcgaguccaucacccuggcgacgggcccgcucaccacccugugggaggggagccccggcaaguucuggaacaccacgaucgccguguccauggccaacaucuuccgcggcagcuaccuggccggggccggccucgcguucucccugaugaagucccucgggggcgggcggcgcgggaccggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagacgaccaagcacgccgugagccggggcaccgcgaagcugcgcugguucguggagcggaaccuggucaagcccgagggcaaggugaucgaccuggggugcggccgcgggggcugguccuacuacugcgccgggcucaagaacuucaccgaggugaagggcuacaccagcggcgggcccggccacgaggagccgauccccauggccacguacggguggaaccuggucaagcugcacuccggcaaggacguguucuucaugccgcccgagaagugcgacacccuccugugcgacaucggggagagcuccccgaaccccaccaucgaggagggccggacccugcgcgugcucaagauggucgagcccuggcugaagggcaaccaguucugcaucaagauccugaaccccuacaugccgagcgugguggagacgcucgagcagaugcagcggaagcacgggggcaugcugguccgcaacccccugucccggaacagcacccacgagauguacuggguguccugcgggaccggcaacaucgugagcgccgucaacaugaccucccgcaugcuccugaaccgguucacgauggcccaccgcaagcccaccuacgagcgcgacguggaccugggcgcggggacccggcacguggccgucgagcccgagguggccaaccucgacaucaucggccagcgcaucgagaacaucaagaacgagcacaagagcaccuggcacuacgacgaggacaacccguacaagacgugggccuaccacggguccuacgaggugaagcccagcggcuccgccagcuccauggucaacgggguggugcggcugcugaccaagcccugggacgucauccccauggugacccagaucgcgaugaccgacacgaccccguucggccagcagcgcgucuucaaggagaagguggacacccggacgccccgcgccaagcggggcacgacccagaucauggaggugaccgccaaguggcucuggggguuccugagccgcaacaagaagccccggaucugcacccgcgaggaguucacgcggaagguccgcagcaacgccgccaucggcgcgguguucguggacgagaaccaguggaacuccgccaaggaggccgucgaggacgagcgguucugggaccuggugcaccgcgagcgggagcuccacaagcaggggaagugcgcgaccugcguguacaacaugaugggcaagcgcgagaagaagcugggggaguucggcaaggcgaagggcagccgggccaucugguacauguggcugggggcccgcuuccucgaguucgaggcccugggcuucaugaacgaggaccacugguucucccgggagaacagccuguccggggucgagggcgaggggcuccacaagcugggcuacauccugcgcgacaucagcaagaucccgggcgggaacauguacgccgacgacaccgcgggcugggacacccggaucacggaggacgaccuccagaacgaggccaagaucaccgacaucauggagcccgagcacgcccugcuggccaccuccaucuucaagcucaccuaccagaacaagguggugcgcguccagcgccccgccaagaacgggacggugauggacgugaucagccggcgcgaccagcggggcuccggccaggucgggaccuacggccugaacaccuucaccaacauggaggugcagcugauccgccagauggagagcgaggggaucuuccuccccuccgagcuggagacgccgaaccuggcggagcgggugcucgacuggcuggagaagcacggcgccgagcgccugaagcggauggccaucagcggggacgacugcgucgugaagcccaucgacgaccgcuucgccaccgcccucaccgcgcugaacgacaugggcaaggugcggaaggacaucccccagugggagcccuccaagggcuggaacgacuggcagcaggucccguucugcagccaccacuuccaccagcugaucaugaaggacgggcgcgagaucguggugcccugccggaaccaggacgagcucgucggccgcgcccgggugucccagggggccggcuggagccugcgcgagaccgccugccuggggaaguccuacgcccagauguggcagcucauguacuuccaccggcgcgaccugcggcuggcggccaacgccaucugcagcgccgugcccgucgacugggugcccaccagccgcacgaccugguccauccacgcgcaccaccaguggaugaccaccgaggacaugcucagcguguggaaccgggucuggaucgaggagaacccguggauggaggacaagacgcacguguccagcugggaggaggugcccuaccugggcaagcgcgaggaccaguggugcggcucccugaucgggcucaccgcccgcgccaccugggccaccaacauccaggucgccaucaaccaggugcggcgccugaucggcaacgagaacuaccuggacuacaugacgagcaugaagcgguucaagaacgaguccgaccccgagggggcgcucugguga

SEQ ID NO: 8264 - RNA, 9879 nt, Artificial Sequence
  derived and/or modified CDS sequence (opt1) from DENV-1__GQ199877__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccuccagccucgaggagcugggggacggccuggcgaugggcaucaugaugcucaagcugcugaccgaguuccagccccaccagcucuggacgacccugcugucccucaccuucgugaagaccacgcugagccuggacuacgccuggaagaccaccgccauggugcucuccaucgucagccuguucccccugugccucuccaccacgagccagaagaccaccuggcugccggugcugcucggguccuucggcugcaagccccugaccauguuccugaucaccgagaacaagaucugggggcgcaagagcuggccccucaacgagggcaucauggccaucgggaucguguccauccugcugagcagccuccugaagaacgacgucccccuggcgggcccgcucaucgccggcgggaugcugaucgccugcuacgugaucuccggcagcuccgccgaccugagccucgagaaggccgcggagguguccugggagcaggaggccgagcacagcggggccucccacaacauccuggucgaggugcaggacgacggcacgaugaagaucaaggacgaggagcgcgacgacacccugaccauccuccugaaggccacccugcucgccgugagcggggucuaccccauguccauccccgcgacgcuguucgugugguacuucuggcagaagaagaagcagcggagcggcgugcugugggacacccccuccccgcccgaggucgagcgcgccgugcucgacgacggcaucuaccggauccugcagcgcgggcugcugggccggagccaggugggggucggcguguuccaggacgggguguuccacaccauguggcacgucacccgcggcgccgugcucauguaccagggcaagcggcuggagcccuccugggccagcgugaagaaggaccugaucuccuacgggggcggguggcgcuuccagggcagcuggaacacgggggaggagguccaggugaucgccguggagcccggcaagaacccgaagaacguccagaccacccccggcaccuucaagacgcccgagggggaggugggcgcgaucgcccucgacuucaagcccgggaccuccggcagcccgaucgugaaccgggagggcaagaucgucgggcuguacggcaacgggguggugaccaccuccggcacguacgucagcgccaucgcccaggccaaggcgagccaggaggggccccugcccgagaucgaggacgagguguucaagaagcgcaaccucaccaucauggaccugcacccgggcuccggcaagacccggcgcuaccugcccgccaucgugcgggaggccaucaagcgcaagcuccgcacccugauccuggcccccacgcgggucguggcgagcgagauggccgaggcccucaaggggaugcccauccgcuaccagaccaccgccgugaaguccgagcacaccggccgggagaucgucgaccugaugugccacgccacguucaccaugcgccugcucagcccggugcgggugcccaacuacaacaugaucaucauggacgaggcgcacuucaccgaccccgccuccaucgccgcccgcggguacaucagcacccgggucggcaugggggaggccgcggccaucuucaugacggccacgccgcccggcuccguggaggccuucccccagagcaacgccgugauccaggacgaggagcgcgacauccccgagcgguccuggaacagcggcuacgacuggaucaccgacuuccccgggaagaccgucugguucgugcccuccaucaagagcggcaacgacaucgcgaacugccugcgcaagaacgggaagcgggugauccagcugucccgcaagacguucgacaccgaguaccagaagaccaagaacaacgacugggacuacgucgugaccacggacaucagcgagaugggcgccaacuuccgggccgaccgcgugaucgacccccggcgcugccucaagcccgucauccugaaggacgggcccgagcgggugauccuggccggcccgaugcccgucaccguggcguccgccgcccagcgccggggccgcaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagacguucgucgagcugaugcggcgcggcgaccuccccguguggcuguccuacaagguggccagcgagggguuccaguacuccgaccggcgcuggugcuucgacggcgagcggaacaaccagguccuggaggagaacauggacguggagaucuggaccaaggagggggagcgcaagaagcuccggccccgcuggcuggacgcgcggaccuacagcgacccgcuggcccuccgcgaguucaaggaguucgccgccggccggcgcagcguguccggcgaccugauccuggagaucgggaagcucccccagcaccugacccugcgggcccagaacgcgcucgacaaccuggucaugcugcacaacagcgagcagggcgggaaggccuaccgccacgccauggaggagcuccccgacaccaucgagacgcugaugcugcucgcccugaucgcggugcugaccggcggggugacccucuucuuccuguccggcaagggccuggggaagaccagcaucggccuccugugcgucacggccuccagcgcccugcucuggauggccuccguggagccccacuggaucgccgcgagcaucauccuggaguucuuccugauggugcuccugaucccggagcccgaccggcagcgcacgccccaggacaaccagcuggccuacgucgugaucgggcuccuguucaugauccugaccguggccgccaacgagaugggccuccuggagaccacgaagaaggaccuggggaucggcuacgucgccgcggagaaccaccagcacgccaccaugcucgacguggaccugcacccggccuccgccuggacccuguacgccguggcgaccacggucaucacccccaugaugcggcacaccaucgagaacaccacggccaacaucagccucaccgccaucgccaaccaggccgcgauccugaugggccuggacaagggguggcccaucuccaagauggacaucggcgugccccuccuggcccuggggugcuacagccaggugaacccgcucacccugaccgccgccguccugaugcucguggcgcacuacgccaucaucggccccgggcugcaggccaaggccacgcgcgaggcccagaagcgcaccgcggccggcaucaugaagaaccccaccguggacggcaucgucgccaucgaccuggaccccgugguguacgacgccaaguucgagaagcagcucgggcagaucaugcugcugauccucugcaccucccagauccugcugaugcggacgaccugggcccucugcgagagcaucacccuggcgaccggcccgcugacgacccucugggaggggucccccggcaaguucuggaacaccaccaucgccgucagcauggccaacaucuuccgcggcuccuaccuggccggggccggccuggcguucagccucaugaagucccucgggggcgggcggcgcggcacgggcgcccagggggagacccugggcgagaaguggaagcggcagcucaaccagcugagcaagagcgaguucaacaccuacaagaaguccgggaucauggagguggaccgcagcgaggccaaggagggccugaagcgcggggagaccacgaagcacgccgugucccgcggcaccgcgaagcuccggugguucgucgagcgcaaccuggugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccucgugaagcugcacuccggcaaggacgucuucuucaugccgcccgagaagugcgacacgcugcucugcgacaucggggagagcuccccgaaccccaccaucgaggagggccgcacccugcgggugcugaagaugguggagcccuggcuccgcggcaaccaguucugcaucaagauccugaaccccuacaugccgagcgucguggagacccuggagcagaugcagcggaagcacgggggcaugcucgugcgcaacccccugucccggaacagcacgcacgagauguacugggucuccugcgggaccggcaacaucgugagcgccgugaacaugaccucccgcaugcugcucaaccgguucaccauggcccaccgcaagcccacguacgagcgcgacgucgaccugggcgcggggacccggcacguggccguggagcccgaggucgccaaccuggacaucaucggccagcgcaucgagaacaucaagaacgagcacaagagcaccuggcacuacgacgaggacaacccguacaagaccugggccuaccacggguccuacgaggugaagcccagcggcuccgccagcuccauggucaacgggguggugcggcuccugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcuguggggguuccucagccgcaacaagaagccccggaucugcacccgcgaggaguucacccggaaggugcgcagcaacgccgccaucggcgcggucuucguggacgagaaccaguggaacuccgccaaggaggccguggaggacgagcgguucugggaccugguccaccgcgagcgggagcugcacaagcaggggaagugcgccacgugcguguacaacaugaugggcaagcgcgagaagaagcucggggaguucggcaaggcgaagggcagccgggccaucugguacauguggcugggggcccgcuuccuggaguucgaggcccucggcuucaugaacgaggaccacugguucucccgggagaacagccuguccgggguggagggcgaggggcugcacaagcucggcuacauccugcgcgacaucagcaagaucccgggcgggaacauguacgccgacgacaccgcgggcugggacacccggaucaccgaggacgaccugcagaacgaggccaagaucacggacaucauggagcccgagcacgcccuccuggccaccuccaucuucaagcugaccuaccagaacaaggucgugcgcgugcagcgccccgccaagaacgggaccgucauggacgugaucagccggcgcgaccagcggggcuccggccagguggggacguacggccucaacaccuucaccaacauggagguccagcugauccgccagauggagagcgaggggaucuuccugcccuccgagcucgagaccccgaaccuggcggagcgggcccuggacuggcucgagaagcacggcgccgagcgccugaagcggauggccaucagcggggacgacugcguggugaagcccaucgacgaccgcuucgccacggcgcugaccgcccucaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcuggugggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgcgguccccguggacugggugcccaccagccgcaccacgugguccauccacgcccaccaccaguggaugaccaccgaggacaugcugagcgucuggaaccggguguggaucgaggagaacccguggauggaggacaagacccacguguccagcugggaggagguccccuaccucggcaagcgcgaggaccaguggugcggcucccugaucgggcugacggcccgcgccaccugggccaccaacauccagguggcgaucaaccaggugcggcgccucaucggcaacgagaacuaccuggacuacaugaccagcaugaagcgguucaagaacgaguccgaccccgagggggcccugugguga

SEQ ID NO: 8265 - RNA, 9879 nt, Artificial Sequence
  derived and/or modified CDS sequence (opt1) from DENV-1__GU056029__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugccccacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcgcgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucguccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagccccaccagcucuggacgacccugcugagccucaccuucgugaagaccgcgcugucccuggacuacgccuggaagacgaccgccaugguccucagcaucgugucccuguucccccugugccucagcaccaccucccagaagacgaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccuggcgggcccgcucaucgccggcgggaugcugaucgccugcuacgugaucagcggcuccagcgccgaccugucccucgagaaggccgcggaggucagcugggagcaggaggccgagcacuccggggccagccacaacauccugguggaggugcaggacgacggcaccaugaagaucaaggacgaggagcgcgacgacacgcugaccauccuccugaaggccacccugcucgccgucuccgggguguaccccaugagcauccccgcgacccuguucgugugguacuucuggcagaagaagaagcagcgguccggcguccugugggacacgcccagcccgcccgagguggagcgcgccgugcucgacaacggcaucuaccggauccugcagcgcgggcugcugggccggucccaggucggggugggcguguuccaggacggggucuuccacaccauguggcacgugacccgcggcgccgugcucauguaccagggcaagcggcuggagcccagcugggccuccgucaagaaggaccugaucagcuacgggggcggguggcgcuuccagggcuccuggaacaccggggaggagguccaggugaucgccgucgagcccggcaagaacccgaagaacgugcagacgacccccggcaccuucaagacccccgagggggaggugggcgcgaucgcccucgacuucaagcccgggacgagcggcuccccgaucgucaaccgggagggcaagaucguggggcuguacggcaacgggguggucaccaccagcggcaccuacguguccgccaucgcccaggccaaggcgagccaggaggggccccugcccgagaucgaggacgagguguucaagaagcgcaaccucacgaucauggaccugcacccgggcagcggcaagacccggcgcuaccugcccgccaucguccgggaggccaucaagcgcaagcuccgcacccugauccuggcccccacccgggugguggcguccgagauggccgaggcccucaaggggaugcccauccgcuaccagacgaccgccgucaagagcgagcacaccggccgggagaucguggaccugaugugccacgccaccuucacgaugcgccugcucuccccggugcggguccccaacuacaacaugaucaucauggacgaggcgcacuucaccgaccccgccagcaucgccgcccgcggguacaucuccacccgggugggcaugggggaggccgcggccaucuucaugaccgccacgcccccgggcagcguggaggccuucccccaguccaacgccgucauccaggacgaggagcgcgacauccccgagcggagcuggaacuccggcuacgacuggaucaccgacuuccccgggaagaccgugugguucgugccgagcaucaaguccggcaacgacaucgcgaacugccugcgcaagaacgggaagcgggucauccagcugagccgcaagaccuucgacacggaguaccagaagaccaagaacaacgacugggacuacguggugaccaccgacaucuccgagaugggcgccaacuuccgggccgaccgcgucaucgacccccggcgcugccucaagcccgugauccugaaggacgggcccgagcgggucauccuggccggcccgaugcccgugacgguggcgagcgccgcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgccgccaucgacggggaguaccgccugcggggcgaggcccgcaagaccuucguggagcugaugcggcgcggcgaccuccccguguggcugagcuacaaggucgccuccgagggguuccaguacagcgaccggcgcuggugcuucgacggcgagcggaacaaccaggugcuggaggagaacauggacguggagaucuggacgaaggagggggagcgcaagaagcuccggccccgcuggcuggacgcgcggaccuacuccgacccgcuggcccuccgcgaguucaaggaguucgccgccggccggcgcagcgucagcggcgaccugauccuggagaucgggaagcucccccagcaccugacccugcgggcccagaacgcgcucgacaaccuggugaugcugcacaacuccgagcagggcgggaaggccuaccgccacgccauggaggagcuccccgacaccaucgagacccugaugcugcucgcccugaucgcggugcugacgggcggggucacccucuucuuccugagcggcaagggccuggggaagaccuccaucggccuccugugcgugaccgccagcuccgcccugcucuggauggccagcguggagccccacuggaucgccgcguccaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagaccaccaagaaggaccuggggaucggcuacguggccgcggagaaccaccagcacgccacgaugcucgacguggaccugcacccggccagcgccuggacccuguacgccgucgcgaccaccgugaucacgcccaugaugcggcacaccaucgagaacaccaccgccaacaucucccucacggccaucgccaaccaggccgcgauccugaugggccuggacaagggguggcccaucagcaagauggacaucggcgugccccuccuggcccuggggugcuacucccaggucaacccgcucacccugaccgccgccgugcugaugcucguggcgcacuacgccaucaucggccccgggcugcaggccaaggccacccgcgaggcccagaagcgcacggcggccggcaucaugaagaaccccaccgucgacggcaucguggccaucgaccuggaccccguggucuacgacgccaaguucgagaagcagcucgggcagaucaugcugcugauccucugcaccagccagauccugcugaugcggaccacgugggcccucugcgaguccaucacccuggcgaccggcccgcugaccacgcucugggaggggagccccggcaaguucuggaacaccaccaucgccguguccauggccaacaucuuccgcggcagcuaccuggccggggccggccuggcguucucccucaugaagucccucgggggcgggcggcgcgggaccggcgcccagggggagacgcugggcgagaaguggaagcggcagcucaaccagcuguccaagagcgaguucaacaccuacaagcgcagcgggaucauggagguggaccgguccgaggccaaggagggccugaagcgcggggagaccaccaagcacgccgucagccggggcacggcgaagcuccgcugguucguggagcggaaccuggugaagcccgagggcaaggucaucgaccuggggugcggccgcgggggcugguccuacuacugcgccgggcugaagaaggugaccgaggugaagggcuacaccaagggcgggcccggccacgaggagccgauccccauggccaccuacggguggaaccucgucaagcugcacagcggcaaggacguguucuucaugccgcccgagaagugcgacacccugcucugcgacaucggggaguccagcccgaaccccacgaucgaggagggccggacccugcgcgugcugaagauggucgagcccuggcuccggggcaaccaguucugcaucaagauccugaaccccuacaugccguccgugguggagacccuggagcagaugcagcgcaagcacgggggcaugcucguccggaacccccugagccgcaacuccacccacgagauguacugggugagcugcgggacgggcaacaucguguccgccgucaacaugaccagccggaugcugcucaaccgcuucaccauggcccaccgcaagcccaccuacgagcgggacguggaccugggcgcggggacgcgccacguggccgucgagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccuccugaccaagcccugggacgugauccccauggugacgcagaucgcgaugaccgacaccaccccguucggccagcagcgggucuucaaggagaagguggacacgcgcacgccccgggccaagcgcggcaccacccagaucauggaggugacggccaaguggcuguggggguuccucucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccuggugcaccgggagcgcgagcugcacaagcaggggaagugcgcgaccugcguguacaacaugaugggcaagcgggagaagaagcucggggaguucggcaaggcgaagggcucccgcgccaucugguacauguggcugggggcccgguuccuggaguucgaggcccucggcuucaugaacgaggaccacugguucagccgcgagaacucccugagcggggucgagggcgaggggcugcacaagcucggcuacauccugcgggacaucuccaagaucccgggcgggaacauguacgccgacgacacggcgggcugggacacccgcaucaccgaggacgaccugcagaacgaggccaagaucaccgacaucauggagcccgagcacgcccuccuggccacgagcaucuucaagcugaccuaccagaacaagguggugcgcguccagcggcccgccaagaacgggaccgugauggacgugaucucccgccgggaccagcgcggcagcggccaggucgggaccuacggccucaacacguucaccaacauggaggugcagcugauccggcagauggaguccgaggggaucuuccugcccagcgagcucgagaccccgaaccuggcggagcgcgcccuggacuggcucgagaagcacggcgccgagcggcugaagcgcauggccaucuccggggacgacugcguggucaagcccaucgacgaccgguucgccaccgcgcugacggcccucaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcuggugggccgggcccgcgucagccagggggccggcuggucccuccgggagaccgccugccugggcaagagcuacgcgcagauguggcagcugauguacuuccaccgccgggaccuccgccuggccgccaacgccaucugcuccgcggugcccguggacuggguccccaccagccggaccaccuggagcauccacgcccaccaccaguggaugacgaccgaggacaugcuguccguguggaaccgcguguggaucgaggagaacccguggauggaggacaagacccacgucagcuccugggaggaggugcccuaccucggcaagcgcgaggaccaguggugcggcagccugaucgggcugaccgcccgggccacgugggccaccaacauccagguggcgaucaaccagguccgccggcucaucggcaacgagaacuaccuggacuacaugaccuccaugaagcgcuucaagaacgagagcgacuccgagggggcccugugguga

SEQ ID NO: 8266 - RNA, 9879 nt, Artificial Sequence
  derived and/or modified CDS sequence (opt1) from DENV-1__GU056030__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccacccgggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugcgguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccugugguccaacgggguccucgagagcgagaugaucauccccaagaucuacggcgggccgaucucccagcacaacuaccgccccggcuacuacacccagaccgccgggcccuggcaccugggcaagcuggagcucgacuucgaccugugcgagggcacgaccgugguggucgacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgugaaggagaaggaggagaaccugguccggagcaugguguccgccggcagcggggagguggacaacuucagccucggcauccugugcgucuccaucaugaucgaggaggugaugcgcagccgcuggucccggaagaugcugaugaccgggacgcucgccguguuccugcugcucaucaugggccagcugaccuggaacgaccugauccgccucugcaucauggucggggccaacgcgagcgacggcaugggcauggggaccaccuaccuggcccugauggccacguucaagaugcggccgauguucgccgugggccuccuguuccgccggcugaccucccgcgaggugcuccugcugaccaucgggcucagccuggucgccuccguggagcugcccaacagccucgaggagcugggcgacggccuggcgauggggaucaugaugcucaagcugcugaccgaguuccagccccaccagcucuggacgacccugcugucccucaccuucgucaagaccacgcugagccuggacuacgccuggaagaccaccgccauggugcucuccaucgugagccuguucccccugugccucuccaccacgagccagaagaccaccuggcugccgguccugcucggcuccuucgggugcaagccccugaccauguuccugaucaccgagaacaagaucuggggccgcaagagcuggccccucaacgaggggaucauggccaucggcaucguguccauccugcugagcucccuccugaagaacgacgugccccuggcgggcccgcucaucgccgggggcaugcugaucgccugcuacgucaucagcgggagcuccgccgaccugagccucgacaaggccgcggagguguccugggagcaggaggccgagcacagcggcgccucccacaacaucagcguggagguccaggacgacgggacgaugaagaucaaggacgaggagcgcgacgacacccugaccauccugcucaaggccacccugcuggccguguccggcguguaccccaugagcauccccgcgacccucuucgucugguacuucuggcagaagaagaagcagcgguccggcgugcugugggacacccccagcccgcccgagguggagcgcgccguccuggacgacgggaucuaccggauccuccagcgcggccugcuggggcggucccaggugggcgugggggucuuccaggacggcguguuccacaccauguggcacgugacccgcggcgccguccugauguaccaggggaagcggcucgagcccagcugggccugcgugaagaaggaccugaucuccuacggcgggggcuggcgcuuccaggggagcuggaacacgggcgaggaggugcaggucaucgccguggagcccggcaagaacccgaagaacgugcagaccacccccgggaccuucaagacgcccgagggcgaggucggggcgaucgcccuggacuucaagcccggcaccuccggcagcccgaucgugaaccgggaggggaagaucgugggccucuacgggaacggcgucgugaccaccuccgggacguacgugagcgccaucgcccaggccaaggcgucccaggagggcccccugcccgagaucgaggacgaggucuucaagaagcgcaaccugaccaucauggaccuccacccgggcagcgggaagacccggcgcuaccugcccgccaucgugcgggaggccaucaagcgcaagcugcgcacccucauccuggcccccacgcggguggucgcgagcgagauggccgaggcccugaagggcaugcccauccgcuaccagaccaccgccgugaaguccgagcacaccgggcgggagaucguggaccucaugugccacgccacguucaccaugcgccugcugagcccgguccgggugcccaacuacaacaugaucaucauggacgaggcgcacuucaccgaccccgccuccaucgccgcccgcggcuacaucagcacccggguggggaugggcgaggccgcggccaucuucaugacggccacgccgcccggcuccgucgaggccuucccccagagcaacgccgugauccaggacgaggagcgcgacauccccgagcgguccuggaacagcggguacgacuggaucaccgacuuccccggcaagaccgugugguucguccccuccaucaagagcgggaacgacaucgcgaacugccuccgcaagaacggcaagcgggugauccagcugucccgcaagacguucgacaccgaguaccagaagaccaagaacaacgacugggacuacguggucaccacggacaucagcgagaugggggccaacuuccgggccgaccgcgugaucgacccccggcgcugccugaagcccgugauccucaaggacggccccgagcgggucauccuggccggcccgaugcccgugaccgucgcguccgccgcccagcgccgggggcgcaucggccgcaaccagaacaaggagggggaccaguacguguacaugggccagccccugaacaacgacgaggaccacgcccacuggaccgaggccaagaugcuccuggacaacaucaacacccccgaggggaucaucccggcgcuguucgagcccgagcgggagaaguccgccgccaucgacggcgaguaccgccuccggggcgaggcccgcaagacguucguggagcugaugcggcgcggggaccugcccgucuggcucuccuacaagguggccagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcgcggaccuacagcgacccgcuggcccugcgcgaguucaaggaguucgccgccggccggcgcuccgugagcggggaccucauccuggagaucggcaagcugccccagcaccucacccugcgggcccagaacgcgcuggacaaccucgugaugcugcacaacagcgagcagggcgggaaggccuaccgccacgccauggaggagcugcccgacaccaucgagacgcucaugcugcuggcccucaucgcgguccugaccgggggcgugacccuguucuuccucuccggcaaggggcugggcaagaccagcaucgggcugcucugcgugacggccuccagcgcccugcuguggauggccuccgucgagccccacuggaucgccgcgagcaucauccucgaguucuuccugauggugcugcucaucccggagcccgaccggcagcgcacgccccaggacaaccagcuggccuacguggucaucggccuccucuucaugauccugaccguggccgccaacgagauggggcugcucgagaccacgaagaaggaccugggcaucggcuacguggccgcggagaaccaccagcacgccaccaugcuggacgucgaccuccacccggccuccgccuggacccuguacgccguggcgaccacggugaucacccccaugaugcggcacaccaucgagaacaccacggccaacaucagccugaccgccaucgccaaccaggccgcgauccucauggggcuggacaagggcuggcccaucuccaagauggacaucggggucccccugcucgcccugggcugcuacagccaggugaacccgcugacccucaccgccgccgugcugaugcuggucgcgcacuacgccaucaucgggcccggccuccaggccaaggccacgcgcgaggcccagaagcgcaccgcggccggcaucaugaagaaccccaccguggacgggaucguggccaucgaccuggaccccgucguguacgacgugaaguucgagaagcagcugggccagaucaugcuccugauccugugcaccucccagauccuccugaugcggacgaccugggcccugugcgagagcaucacccucgccaccgggccgcugacgacccugugggagggcucccccggcaaguucuggaacaccaccaucgcggucagcauggccaacaucuuccgcggguccuaccucgccggcgccgggcuggccuucagccugaugaagucccucggcgggggccggcgcggcacgggggcgcagggcgagacccugggggagaaguggaagcggcagcugaaccagcucagcaaguccgaguucaacaccuacaagcgcagcggcaucauggagguggaccggagcgaggccaaggaggggcugaagcgcggcgagaccacgaaccacgccgugucccggggcaccgccaagcugcgcugguucgucgagcggaaccucgugaagcccgaggggaaggugaucgaccugggcugcgggcgcggcggguggagcuacuacugcgcgggccugaagaaggucaccgaggugaagggcuacaccaagggcgggcccgggcacgaggagccgauccccauggccaccuacggcuggaaccuggugaagcuccacuccgggaaggacgucuucuucaugccgcccgagaagugcgacacgcugcugugcgacaucggcgagagcuccccgaaccccaccaucgaggagggccggacccuccgcgugcugaagaugguggagcccuggcugcgggggaaccaguucugcaucaagauccucaaccccuacaugccgagcgucguggagacccuggagcagaugcagcgcaagcacggcgggaugcuggugcggaacccccucucccgcaacagcacgcacgagauguacugggucuccugcggcaccggcaacaucgugagcgccgugaacaugaccucccggaugcugcugaaccgcuucaccauggcccaccgcaagcccacguacgagcgggacgucgaccucggggccggcacccgccacgugaccguggagcccgaggucgcgaaccuggacaucaucgggcagcggaucgagaacaucaagaacgagcacaagagcaccuggcacuacgacgaggacaacccguacaagacgugggccuaccacggcuccuacgaggugaagcccagcggguccgccagcuccauggucaacggcguggugcgccugcucaccaagcccugggacgucauccccauggugacccagaucgccaugaccgacacgaccccguucggccagcagcggguguucaaggagaaggucgacacccgcacgccccgggccaagcgcgggacgacccagaucauggaggugaccgcgaaguggcuguggggcuuccugagccggaacaagaagccccgcaucugcacccgggaggaguucacgcgcaaggugcgguccaacgccgccaucggggccgucuucguggacgagaaccaguggaacagcgccaaggaggcgguggaggacgagcgcuucugggaccucguccaccgggagcgcgagcugcacaagcagggcaagugcgcgaccugcguguacaacaugauggggaagcgggagaagaagcugggcgaguucggcaaggccaaggggagccgcgccaucugguacauguggcucggcgcgcgguuccuggaguucgaggcccugggguucaugaacgaggaccacugguucucccgcgagaacagccucuccggcguggagggggagggccugcacaagcugggcuacauccuccgggacaucagcaagauccccggcgggaacauguacgccgacgacaccgccgggugggacacccgcaucacggaggacgaccugcagaacgaggccaagaucaccgacaucauggagcccgagcacgcgcugcucgccaccuccaucuucaagcugaccuaccagaacaaggucgugcgcgugcagcggcccgccaagaacgggacggucauggacgugaucagccgccgggaccagcgcggcuccggccaggugggcaccuacgggcugaacaccuucaccaacauggagguccagcucauccggcagauggagagcgagggcaucuuccugcccuccgagcuggagacgccgaaccucgccgagcgcgugcuggacuggcuggagaagcacggggccgagcggcucaagcgcauggcgaucagcggcgacgacugcguggucaagcccaucgacgaccgguucgccaccgcccugaccgcccugaacgacaugggcaaggugcgcaaggacaucccccagugggagcccuccaagggguggaacgacuggcagcaggucccguucugcagccaccacuuccaccagcucaucaugaaggacggccgggagaucgucgugcccugccgcaaccaggacgagcugguggggcgggcccgcgucucccagggcgcgggguggagccugcgggagaccgccugccucggcaaguccuacgcccagauguggcagcugauguacuuccaccgccgggaccugcgccucgccgccaacgcgaucugcagcgccgugcccguggacuggguccccaccucccggacgaccuggagcauccacgcccaccaccaguggaugaccaccgaggacaugcugagcguguggaaccgcguguggaucgaggagaacccguggauggaggacaagacgcacgucuccagcugggaggaggugcccuaccugggcaagcgcgaggaccaguggugcgggucccucaucggccugaccgcccgggcgaccugggccaccaacauccagguggccaucaaccagguccgccggcugaucgggaacgagaacuaccucgacuacaugacgagcaugaagcgcuucaagaacgaguccgaccccgagggcgcccugugguga

SEQ ID NO: 8267 - RNA, 9879 nt, Artificial Sequence
  derived and/or modified CDS sequence (opt1) from DENV-1__GU056031__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucaaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagcccuccaccauguuccugaucaccgagaacaagaucugggggcgcaagagcuggccccugaacgagggcaucauggccaucgggaucguguccauccuccugagcagccugcucaagaacgacgucccccuggcgggcccgcugaucgccggcgggaugcucaucgccugcuacgugaucuccggcagcuccgccgaccugagccuggagaaggccgcggagguguccugggagcaggaggccgagcacagcggggccucccacaacauccucgucgaggugcaggacgacggcacgaugaagaucaaggacgaggagcgcgacgacacccugaccauccugcucaaggccacccugcuggccgugagcggggucuaccccauguccauccccgcgacccucuucgugugguacuucuggcagaagaagaagcagcggagcggcgugcugugggacacccccuccccgcccgaggucgagcgcgccgugcuggacgacggcaucuaccggauccuccagcgcgggcugcugggccggagccaggugggggucggcguguuccaggacgggguguuccacaccauguggcacgucacccgcggcgccgugcugauguaccagggcaagcggcucgagcccuccugggccagcgugaagaaggaccugaucuccuacgggggcggguggcgcuuccagggcagcuggaacacgggggaggagguccaggugaucgccguggagcccggcaagaacccgaagaacguccagaccacccccggcaccuucaagacgcccgagggggaggugggcgcgaucgcccuggacuucaagcccgggaccuccggcagcccgaucgugaaccgggagggcaagaucgucgggcucuacggcaacgggguggugaccaccuccggcacguacgucagcgccaucgcccaggccaaggcgagccaggaggggccccugcccgagaucgaggacgagguguucaagaagcgcaaccugaccaucauggaccuccacccgggcuccggcaagacccggcgcuaccugcccgccaucgugcgggaggccaucaagcgcaagcugcgcacccucauccuggcccccacgcgggucguggcgagcgagauggccgaggcccugaaggggaugcccauccgcuaccagaccaccgccgugaaguccgagcacaccggccgggagaucgucgaccucaugugccacgccacguucaccaugcgccugcugagcccggugcgggugcccaacuacaacaugaucaucauggacgaggcgcacuucaccgaccccgccuccaucgccgcccgcggguacaucagcacccgggucggcaugggggaggccgcggccaucuucaugacggccacgccgcccggcuccguggaggccuucccccagagcaacgccgugauccaggacgaggagcgcgacauccccgagcgguccuggaacagcggcuacgacuggaucaccgacuuccccgggaagaccgucugguucgugcccuccaucaagagcggcaacgacaucgcgaacugccuccgcaagaacgggaagcgggugauccagcugucccgcaagacguucgacaccgaguaccagaagaccaagaacaacgacugggacuacgucgugaccacggacaucagcgagaugggcgccaacuuccgggccgaccgcgugaucgacccccggcgcugccugaagcccgucauccucaaggacgggcccgagcgggugauccuggccggcccgaugcccgucaccguggcguccgccgcccagcgccggggccgcaucgggcgcaaccagaacaaggagggcgaccaguacguguacauggggcagccccugaacaacgacgaggaccacgcccacuggaccgaggccaagaugcuccuggacaacaucaacacccccgagggcaucaucccggcgcuguucgagcccgagcgggagaaguccgccgccaucgacggggaguaccgccuccggggcgaggcccgcaagacguucgucgagcugaugcggcgcggcgaccugcccguguggcucuccuacaagguggccagcgagggguuccaguacuccgaccggcgcuggugcuucgacggcgagcggaacaaccagguccuggaggagaacauggacguggagaucuggaccaaggagggggagcgcaagaagcugcggccccgcuggcucgacgcgcggaccuacagcgacccgcuggcccugcgcgaguucaaggaguucgccgccggccggcgcagcguguccggcgaccucauccuggagaucgggaagcugccccagcaccucacccugcgggcccagaacgcgcuggacaaccucgucaugcugcacaacagcgagcagggcgggaaggccuaccgccacgccauggaggagcugcccgacaccaucgagacgcucaugcugcuggcccucaucgcggugcugaccggcggggugacccuguucuuccucuccggcaagggccuggggaagaccagcaucggccugcucugcgucacggccuccagcgcccugcuguggauggccuccguggagccccacuggaucgccgcgagcaucauccucgaguucuuccugauggugcugcucaucccggagcccgaccggcagcgcacgccccaggacaaccagcuggccuacgucgugaucgggcuccucuucaugauccugaccguggccgccaacgagaugggccugcucgagaccacgaagaaggaccuggggaucggcuacgucgccgcggagaaccaccagcacgccaccaugcuggacguggaccuccacccggccuccgccuggacccuguacgccguggcgaccacggucaucacccccaugaugcggcacaccaucgagaacaccacggccaacaucagccugaccgccaucgccaaccaggccgcgauccucaugggccuggacaagggguggcccaucuccaagauggacaucggcgugccccugcucgcccuggggugcuacagccaggugaacccgcugacccucaccgccgccguccugaugcugguggcgcacuacgccaucaucggccccgggcuccaggccaaggccacgcgcgaggcccagaagcgcaccgcggccggcaucaugaagaaccccaccguggacggcaucgucgccaucgaccuggaccccgugguguacgacgccaaguucgagaagcagcuggggcagaucaugcuccugauccugugcaccucccagauccuccugaugcggacgaccugggcccugugcgagagcaucacccucgcgaccggcccgcugacgacccugugggaggggucccccggcaaguucuggaacaccaccaucgccgucagcauggccaacaucuuccgcggcuccuaccucgccggggccggccuggcguucagccugaugaagucccucgggggcgggcggcgcggcacgggcgcccagggggagacccugggcgagaaguggaagcggcagcugaaccagcucagcaagagcgaguucaacaccuacaagcgcuccgggaucauggagguggaccggagcgaggccaaggagggccugaagcgcggggagaccacgaagcacgccgugucccggggcaccgcgaagcugcgcugguucgucgagcggaaccucgugaagcccgagggcaaggugaucgaccuggggugcggccgcgggggcuggagcuacuacugcgccgggcugaagaaggucaccgaggugaagggcuacaccaagggcgggcccggccacgaggagccgauccccauggccaccuacggguggaaccuggugaagcuccacuccggcaaggacgucuucuucaugccgcccgagaagugcgacacgcugcugugcgacaucggggagagcuccccgaaccccaccaucgaggagggccggacccuccgcgugcugaagaugguggagcccuggcugcggggcaaccaguucugcaucaagauccucaaccccuacaugccgagcgucguggagacccuggagcagaugcagcgcaagcacgggggcaugcuggugcggaacccccucucccgcaacagcacgcacgagauguacugggucuccugcgggaccggcaacaucgugagcgccgugaacaugaccucccggaugcugcugaaccgcuucaccauggcccaccgcaagcccacguacgagcgggacgucgaccucggcgcggggacccgccacguggccguggagcccgaggucgccaaccuggacaucaucggccagcggaucgagaacaucaagaacgagcacaagagcaccuggcacuacgacgaggacaacccguacaagaccugggccuaccacggguccuacgaggugaagcccagcggcuccgccagcuccauggucaacgggguggugcgccugcucacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcuguggggguuccugagccggaacaagaagccccgcaucugcacccgggaggaguucacccgcaaggugcggagcaacgccgccaucggcgcggucuucguggacgagaaccaguggaacuccgccaaggaggccguggaggacgagcgcuucugggaccucguccaccgggagcgcgagcugcacaagcaggggaagugcgccacgugcguguacaacaugaugggcaagcgggagaagaagcugggggaguucggcaaggcgaagggcagccgcgccaucugguacauguggcucggggcccgguuccuggaguucgaggcccugggcuucaugaacgaggaccacugguucucccgcgagaacagccucuccgggguggagggcgaggggcugcacaagcugggcuacauccuccgggacaucagcaagaucccgggcgggaacauguacgccgacgacaccgcgggcugggacacccgcaucaccgaggacgaccugcagaacgaggccaagaucacggacaucauggagcccgagcacgcccugcucgccaccuccaucuucaagcugaccuaccagaacaaggucgugcgcgugcagcggcccgccaagaacgggaccgucauggacgugaucagccgccgggaccagcgcggcuccggccagguggggacguacggccugaacaccuucaccaacauggagguccagcucauccggcagauggagagcgaggggaucuuccugcccuccgagcuggagaccccgaaccucgcggagcgcgcccuggacuggcuggagaagcacggcgccgagcggcucaagcgcauggccaucagcggggacgacugcguggugaagcccaucgacgaccgguucgccacggcgcugaccgcccugaacgacaugggcaagguccgcaaggacaucccccagugggagcccuccaagggcuggaacgacuggcagcaggucccguucugcagccaccacuuccaccagcucaucaugaaggacgggcgggagaucgugguccccugccgcaaccaggacgagcuggugggccgggcccgcgugucccagggggccggcuggagccugcgggagaccgccugccucgggaaguccuacgcgcagauguggcagcugauguacuuccaccgccgggaccugcgccucgccgccaacgccaucugcagcgcgguccccguggacugggugcccaccagccggaccacgugguccauccacgcccaccaccaguggaugaccaccgaggacaugcugagcgucuggaaccgcguguggaucgaggagaacccguggauggaggacaagacccacguguccagcugggaggagguccccuaccugggcaagcgcgaggaccaguggugcggcucccucaucgggcugacggcccgggccaccugggccaccaacauccagguggcgaucaaccaggugcgccggcugaucggcaacgagaacuacagcgacuacaugaccuccaugaagcgcuucaagaacgagagcgaccccgagggggcccucugguga

SEQ ID NO: 8268 - RNA, 9879 nt, Artificial Sequence
  derived and/or modified CDS sequence (opt1) from DENV-1__GU056032__SS-prME
agcguggccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcgcuggcgccccacgugggccuggggcucgagacccgcaccgagaccuggaugagcuccgagggcgccuggaagcagauccagcgggucgagaccugggcccugcgccaccccggguucaccgugaucgcgcuguuccucgcccacgccaucggcacgagcaucacccagaaggggaucaucuucauccugcugaugcucgugacccccuccauggccaugcggugcgucggcaucggcaaccgcgacuucguggaggggcugagcggcgccaccuggguggacgucgugcuggagcacggguccugcgugacgaccauggcgaagaacaagcccacccucgacaucgagcugcugaagaccgaggucacgaaccccgccgugcuccggaagcugugcaucgaggccaagaucagcaacaccaccaccgacucccgcugcccgacgcagggcgaggccacccugguggaggagcaggacgccaacuucgucugccggcgcaccuucguggaccggggcugggggaacggcugcggccucuucggcaaggggagccugcugaccugcgcgaaguucaagugcgugacgaagcucgagggcaagaucguccaguacgagaaccugaaguacuccgugaucgugaccguccacaccggcgaccagcaccagguggggaacgagaccacggagcacggcaccaucgccaccaucacgccccaggcccccaccagcgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacguccggggccagcaccagccaggagaccuggaaccggcaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccgccugaagauggacaagcucacgcugaagggcaccuccuacgucaugugcaccgggagcuucaagcuggagaaggagguggccgagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgcgggcgagaaggcccugaagcuguccugguucaagaaggggagcuccaucggcaagauguucgaggccaccgcccgcggggcccggcgcauggcgauccucggcgacacggccugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgcgaacggcauccuggcccaggggaagaagaugauccggccccagcccauggagcacaaguacuccuggaaguccuggggcaaggccaagaucaucggcgccgacauccagaacacgaccuucaucaucgacgggcccgacaccccggagugccccgacgaccagcgcgcguggaacaucugggaggucgaggacuacggcuucgggaucuucaccacgaacaucuggcugaagcuccgggacuccuacacccagaugugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcacguggcccaagagccacacccucugguccaacggcguccuggagagcgagaugaucauccccaagaucuacgggggcccgaucucccagcacaacuaccgccccggguacuucacccagaccgccggccccuggcaccuggggaagcucgagcuggacuucgaccugugcgagggcacgaccgugguggucgacgagcacugcggcaaccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucguccggagcaugguguccgccggcagcggcgagguggacagcuucucccuggggauccugugcgucagcaucaugaucgaggaggugaugcgcucccgguggagccgcaagaugcucaugaccggcacgcuggccguguuccugcuccugaucauggggcagcugaccuggaacgaccucauccgccugugcaucauggucggcgcgaacgccuccgaccggauggggaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggcgacgggcucgccaugggcaucaugaugcugaagcugcucaccgaguuccagccccaccagcuguggacgacccugcucagccugaccuucaucaagaccacgcugucccucgacuacgccuggaagaccaccgccaugguccugagcaucgugucccuguucccccucugccugagcaccacgucccagaagaccaccuggcugccggugcuccugggcagcuucgggugcaagccccugaccauguuccucaucaccgagaacaagaucuggggccgcaaguccuggccccugaacgaggggaucauggcggucggcaucgugagcaugcugcucuccagccugcugaagaacgacgugccccucgccgggccgcugaucgccggcggcaugcugaucgccugcuacgucaucagcggguccagcgccgaccucucccuggagaaggcggccgaggugagcugggagcaggaggccgagcacuccggcacgagccacaacauccugguggagguccaggacgacgggaccaugaagaucaaggacgaggagcgggacgacacccucaccauccugcugaaggccacgcuccuggccguguccggcguguaccccaugagcauccccgcgacccuguucgucugguacuucuggcagaagaagaagcagcgcuccggggugcucugggacacccccagcccgcccgagguggagcgggccguccuggacgacggcaucuaccgcauccugcagcggggccugcucgggcgcucccaggugggcgugggggucuuccaggacggcguguuccacaccauguggcacgugacgcgcggggccguccugauguaccagggcaagcgccuggagcccagcugggccuccgugaagaaggaccucaucagcuacggcgggggcuggcgguuccagggguccuggaacaccggcgaggaggugcaggucaucgccguggagcccgggaagaacccgaagaacgugcagaccacccccggcacguucaagacccccgagggcgaggucggggcgaucgcccuggacuucaagcccggcaccagcggguccccgaucgugaaccgcgagggcaagaucgugggccuguacgggaacggcgucgugaccacgagcgggaccuacguguccgccaucgcccaggccaaggcgagccaggagggcccccuccccgagaucgaggacgaggucuucaagaagcggaaccugaccaucauggaccugcacccggggagcggcaagacccgccgguaccuccccgccaucgugcgcgaggccaucaagcggaagcugcgcacgcugauccucgcccccacccgcguggucgcguccgagauggccgaggcccugaagggcaugcccauccgguaccagaccaccgccgucaagagcgagcacacggggcgcgagaucguggaccugaugugccacgccaccuucaccaugcggcuccuguccccgguccgcgugcccaacuacaacaugaucaucauggacgaggcgcacuucaccgaccccgccagcaucgccgcccggggcuacaucuccacgcgcguggggaugggcgaggccgcggccaucuucaugaccgccacgccgcccgggagcgucgaggccuucccccaguccaacgccgugauccaggacgaggagcgggacauccccgagcgcagcuggaacuccggcuacgacuggaucaccgacuuccccggcaagacggugugguucguccccagcaucaaguccgggaacgacaucgcgaacugccugcggaagaacggcaagcgcgugauccagcucagccggaagaccuucgacaccgaguaccagaagaccaagaacaacgacugggacuacguggucacgaccgacaucuccgagaugggggccaacuuccgcgccgaccgggugaucgacccccgccggugccugaagcccgugauccugaaggacggccccgagcgcgucauccucgccgggccgaugcccgugaccgucgcgagcgccgcccagcggcgcggccggaucggccgcaaccagaacaaggagggggaccaguacguguacaugggccagccccugaacaacgacgaggaccacgcccacuggaccgaggccaagaugcugcucgacaacaucaacacgcccgaggggaucaucccggcgcuguucgagcccgagcgcgagaaguccgccgccaucgacggcgaguaccggcugcgcggggaggcccggaagaccuucguggagcucaugcgccggggcgaccugcccgucuggcugagcuacaagguggccuccgagggcuuccaguacagcgaccgccgguggugcuucgacggggagcgcaacaaccaggugcucgaggagaacauggacgucgagaucuggaccaaggagggcgagcggaagaagcugcgcccccgguggcuggacgcgcgcaccuacuccgacccgcucgcccugcgggaguucaaggaguucgccgccgggcgccggagcgugagcggcgaccugauccucgagaucggcaagcugccccagcaccugacccuccgcgcccagaacgcgcuggacaaccuggugaugcuccacaacuccgagcagggcgggaaggccuaccggcacgccauggaggagcugcccgacacgaucgagacccugaugcuccuggcccugaucgcgguccucaccgggggcgugacccuguucuuccugagcgggaagggccucggcaagacguccaucgggcugcugugcgugaccgccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucggccugcuguucaugauccucaccguggccgccaacgagauggggcugcuggagacgaccaagaaggaccucggcaucgggcacguggccgcggagaaccaccagcacgccaccaugcuggacgucgaccugcgcccggccagcgccuggacccucuacgccguggcgacgaccgugaucacccccaugaugcggcacaccaucgagaacacgaccgccaacaucucccugaccgccaucgccaaccaggccgcgauccugaugggccucgacaagggcuggcccaucagcaagauggacaucggggucccccugcuggcccucggcugcuacucccaggugaacccgcugacccugacggccgccgugcucaugcuggucgcgcacuacgccaucaucgggcccggccugcaggccaaggccacccgcgaggcccagaagcgcaccgcggccgggaucaugaagaaccccaccguggacggcaucguggccaucgaccucgaccccgucguguacgacgccaaguucgagaagcagcugggccagaucaugcugcucauccugugcacgagccagauccugcucaugcggaccaccugggcccugugcgaguccaucacccuggcgacggggccgcucaccacccugugggagggcagccccgggaaguucuggaacaccacgaucgccguguccauggccaacaucuuccgcggcagcuaccuggccggcgccgggcucgcguucucccugaugaagucccugggcgggggccggcgcgggaccggcgcccagggcgagacccucggggagaaguggaagcggcagcugaaccagcuguccaagagcgaguucaacaccuacaagcgcagcggcaucauggaggucgaccgguccgaggccaaggaggggcucaagcgcggcgagacgaccaagcacgccgugagccgggggaccgcgaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagccgauccccauggccacguacggcuggaaccuggugaagcugcacagcgggaaggacguguucuucaugccgcccgagaagugcgacacccuccugugcgacaucggcgaguccagcccgaaccccaccaucgaggaggggcggacccugcgcguccucaagaugguggagcccuggcugcggggcaaccaguucugcaucaagauccugaaccccuacaugccguccguggucgagacgcucgagcagaugcagcgcaagcacggcgggaugcuggugcggaacccccugagccgcaacuccacccacgagauguacugggugagcugcggcaccgggaacaucgucuccgccgugaacaugaccagccggaugcuccugaaccgcuucacgauggcccaccgcaagcccaccuacgagcgggacguggaccugggcgcgggcacccgccacgucgccguggagcccgagguggccaaccucgacaucaucgggcagcggaucgagaacaucaagaacgagcacaaguccaccuggcacuacgacgaggacaacccguacaagacgugggccuaccacggcagcuacgaggucaagcccuccgggagcgccuccagcauggugaacggcgucgugcgccugcugaccaagcccugggacgugauccccauggucacccagaucgcgaugaccgacacgaccccguucgggcagcagcggguguucaaggagaagguggacacccgcacgccccgggccaagcgcggcacgacccagaucauggaggucaccgccaaguggcucuggggcuuccugucccggaacaagaagccccgcaucugcacccgggaggaguucacgcgcaaggugcggagcaacgccgccaucggggcgguguucgucgacgagaaccaguggaacagcgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgccgacgacaccgcggggugggacacccgcaucacggaggacgaccuccagaacgaggccaagaucaccgacaucauggagcccgagcacgcccugcuggccaccagcaucuucaagcucaccuaccagaacaaggugguccgcgugcagcggcccgccaagaacggcacggugauggacgucaucucccgccgggaccagcgcgggagcggccaggugggcaccuacgggcugaacaccuucaccaacauggaggugcagcugauccggcagauggaguccgagggcaucuuccuccccagcgagcuggagacgccgaaccuggcggagcgcguccucgacuggcuggagaagcacggggccgagcggcugaagcgcauggccaucuccggcgacgacugcguggugaagcccaucgacgaccgguucgccaccgcccucaccgcgcugaacgacauggggaagauccgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcccagauguggcagcucauguacuuccaccgccgggaccugcgccuggcggccaacgccaucugcuccgccgugcccgucgacugggugcccaccagccggacgaccuggagcauccacgcgcaccaccaguggaugaccaccgaggacaugcucuccguguggaaccgcgucuggaucgaggagaacccguggauggaggacaagacgcacgugagcuccugggaggaggugcccuaccuggggaagcgcgaggaccaguggugcggcagccugaucggccucaccgcccgggccaccugggccaccaacauccaggucgccaucaaccaggugcgccggcugaucgggaacgagaacuaccuggacuacaugacguccaugaagcgcuucaagaacgagagcgacaccgagggcgcgcucugguga

SEQ ID NO: 8269 - RNA, 9879 nt, Artificial Sequence
  derived and/or modified CDS sequence (opt1) from DENV-1__GU056033__SS-prME
agcgugaccaugcugcucaugcugcugcccaccgcccucgccuuccaccugaccacccgcggcggggagccccacaugaucgugagcaagcaggagcggggcaagagccuccuguucaagaccagcgugggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcagcgagggcgcguggaagcagauccagcggguggagaccugggcccugcgccaccccggguucacggugaucgcccuguuccucgcccacgcgaucggcaccagcaucacccagaaggggaucaucuucauccugcugaugcucgucacccccuccauggccaugcggugcgugggcaucggcaaccgcgacuucguggaggggcugagcggcgccacgugggucgacguggugcuggagcacggguccugcgucaccaccauggccaagaacaagcccacccucgacaucgagcugcugaagacggaggugaccaaccccgccgugcuccggaagcugugcaucgaggcgaagaucagcaacaccaccacggacucccgcugcccgacccagggcgaggccacccuggucgaggagcaggacgccaacuucgugugccggcgcaccuucguggaccggggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcucaucacggccaacccgaucgugaccgacaaggagaagcccgugaacaucgagaccgagccgcccuucggggagagcuacaucgucgugggcgccggcgagaaggcccugaagcuguccugguucaagaaggggagcuccaucggcaagauguucgaggcgaccgcccgcggggcccggcgcauggccauccucggcgacacggccugggacuucgggagcaucggcggcguguucaccuccgucgggaagcuggugcaccagguguucggcaccgcguacgggguccuguucagcggcguguccuggaccaugaagaucgggaucggcauccuccugacguggcugggccucaacagccgcuccaccagccuguccaugaccugcaucgccguggggauggucacccuguaccucggcgugauggugcaggccgacagcgggugcgucaucaacuggaagggccgggagcugaagugcggguccggcaucuucgugacgaacgaggugcacaccuggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgugaacggcauccuggcccaggggaagaagaugauccggccccagcccauggagcacaaguacuccuggaaguccuggggcaaggccaagaucaucggcgcggacauccagaacacgaccuucaucaucgacgggcccgacaccccggagugccccgacgaccagcgcgccuggaacaucugggagguggaggacuacggcuucgggaucuucaccacgaacaucuggcugaagcuccgggacuccuacacccagaugugcgaccaccgccugaugagcgccgccaucaaggacuccaaggcgguccacgccgacaugggcuacuggaucgagagcgagaagaacgagaccuggaagcuggccaaggccuccuucaucgaggugaagaccugcaucuggcccaagagccacacgcucugguccaacggcgugcuggagagcgagaugaucauccccaagaucuacgggggcccgaucucccagcacaacuaccggcccggguacuucacccagaccgccggccccuggcaccuggggaagcucgagcuggacuucgaccugugcgagggcaccacggucgugguggacgagcacugcggcaaccgcgggccgagccuccggaccaccaccgucacgggcaagaucauccacgaguggugcugccgcuccugcacccugccgccccugcgguuccgcggggaggacggcugcugguacgggauggagauccggcccgugaaggagaaggaggagaaccucgugcgcagcauggucuccgcgggcagcggcgagguggacagcuucucccuggggauccugugcgugagcaucaugaucgaggaggucaugcggucccgcuggagccggaagaugcucaugaccggcacccuggccguguuccugcuccugaucauggggcagcugacguggaacgaccucauccgccugugcaucauggugggcgccaacgccuccgaccgcauggggaugggcaccaccuaccuggcccucauggccaccuucaagaugcggccgauguucgccgucgggcugcuguuccgccggcucacgagccgcgaggugcugcugcucaccaucgggcugucccuggucgccagcguggagcuccccaacucccuggaggagcugggcgacgggcucgccaugggcaucaugaugcugaagcugcucaccgaguuccagccccaccagcuguggaccacgcugcucagccugaccuucaucaagaccacccugucccucgacuacgccuggaagacgaccgcgauggcccugagcaucgugucccuguucccccucugccugagcaccaccucccagaagacgaccuggcugccgguccuccugggcagcuucgggugcaagccccugaccauguuccucaucaccgagaacaagaucuggggccggaaguccuggccccugaacgaggggaucauggccaucggcaucgugagcauccugcucuccagccugcugaagaacgacgugccccucgccgggccgcugaucgcgggcggcaugcugaucgccugcuacgucaucagcggguccagcgccgaccucucccuggagaaggccgccgaggugagcugggagcaggaggcggagcacuccggcaccagccacaacauccugguggagguccaggacgacgggacgaugaagaucaaggacgaggagcgcgacgacacccucaccauccugcugaaggccacccuccuggccguguccggcguguaccccaugagcauccccgccacgcuguucgucugguacuucuggcagaagaagaagcagcgguccggggugcucugggacacccccagcccgcccgagguggagcgcgccguccuggacgacggcaucuaccggaucucccagcgcggccugcuggggcggagccaggugggcgugggggucuuccaggacggcguguuccacaccauguggcacgugacccgcggggcgguccucauguaccagggcaagcggcuggagcccuccugggccagcgugaagaaggaccugaucuccuacggcgggggcuggcgcuuccaggggagcuggaacacgggcgaggaggugcaggucaucgccguggagcccgggaagaacccgaagaacgugcagaccacccccggcaccuucaagacgcccgagggcgaggucggggccaucgcccucgacuucaagcccggcaccuccgggagcccgaucgugaaccgggagggcaagaucgugggccuguacgggaacggcgucgugaccaccuccgggacguacgugagcgcgaucgcccaggccaaggccagccaggagggcccccugcccgagaucgaggacgaggucuucaagaagcgcaaccucaccaucauggaccugcacccgggguccggcaagacccggcgcuaccugcccgccaucgugcgggaggcgaucaagcgcaagcuccggacccugauccuggcccccacgcgcguggucgccagcgagauggccgaggcgcucaagggcaugcccauccgcuaccagaccaccgccgugaaguccgagcacaccgggcgggagaucguggaccugaugugccacgccacguucaccaugcgccugcucagcccgguccgggugcccaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccccagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcugucccgcaagacguucgacaccgaguaccagaagaccaagaacaacgacugggacuacguggucaccacggacaucagcgagaugggggccaacuuccgggcggaccgcgugaucgacccccggcgcugccucaagcccgugauccugaaggacggccccgagcgggucauccuggccgggccgaugcccgugaccgucgccuccgccgcgcagcgccggggccgcaucggccggaaccagaacaaggagggggaccaguacguguacaugggccagccccucaacaacgacgaggaccacgcccacuggaccgaggccaagaugcugcuggacaacaucaacacccccgaggggaucaucccggcccucuucgagcccgagcgcgagaaguccgccgcgaucgacggcgaguaccgccugcgcggggaggcccgcaagacguucguggagcugaugcggcgcggcgaccuccccgucuggcuguccuacaagguggccagcgagggcuuccaguacuccgaccggcgcuggugcuucgacggggagcggaacaaccaggugcuggaggagaacauggacgucgagaucuggaccaaggagggcgagcgcaagaagcuccggccccgcuggcuggacgcccggaccuacagcgacccgcuggcccuccgcgaguucaaggaguucgcggccgggcggcgcagcguguccggcgaccugauccuggagaucggcaagcucccccagcaccugacccugcgggcccagaacgcccucgacaaccuggugaugcugcacaacagcgagcagggcgggaaggccuaccgccacgcgauggaggagcuccccgacaccaucgagacgcugaugcugcucgcccugaucgccguccugaccgggggcgugacccucuucuuccuguccgggaagggccugggcaagaccagcaucgggcuccugugcgugacggccuccagcgcgcugcucuggauggccuccgucgagccccacuggaucgccgccagcaucauccuggaguucuuccugauggugcuccugaucccggagcccgaccggcagcgcacgccccaggacaaccagcuggccuacguggucaucggccuccuguucaugauccugaccguggcggccaacgagauggggcuccuggagaccacgaagaaggaccugggcaucgggcacguggccgccgagucccaccagcacgccaccaugcucgacgucgaccugcggccggcgagcgccuggacccuguacgccguggccaccacggugaucacccccaugaugcgccacaccaucgagaacaccacggccaacaucucccucaccgcgaucgccaaccaggccgccauccugaugggccuggacaagggcuggcccaucagcaagauggacaucggggucccccuccuggcccugggcugcuacucccaggugaacccgcucacccugaccgcggccgugcugaugcucgucgcccacuacgccaucaucgggcccggccugcaggcgaaggccacgcgggaggcccagaagcgcaccgccgccgggaucaugaagaaccccaccguggacggcaucguggcgaucgaccuggaccccgucguguacgacgccaaguucgagaagcagcucggccagaucaugcugcugauccucugcaccagccagauccugcugaugcgcacgaccugggcccucugcgaguccaucacccuggccaccgggccgcugacgacccucugggagggcagccccgggaaguucuggaacaccaccaucgccguguccauggcgaacaucuuccggggcagcuaccuggccggcgccgggcuggccuucucccucaugaagucccugggcgggggccgccgggggacgggcgcccagggcgagacccugggggagaaguggaagcgccagcucaaccagcugagcaagaccgaguucaacaccuacaagcgguccggcaucauggaggucgaccgcagcgaggcgaaggaggggcugaagcggggcgagacgaccaagcacgccgugucccgcgggaccgccaagcuccggugguucguggagcgcaaccuggucaagcccgagggcaaggugaucgaccugggcugcgggcggggcggguggagcuacuacugcgccggccugaagaaggugaccgaggucaagggguacaccaagggcggccucgggcacgaggagcccaucccgauggcgacguacggcuggaaccuggugaagcugcacuccgggaaggacguguucuucaugccgcccgagaagugcgacacccuccugugcgacaucggcgagagcucccccaacccgaccaucgaggaggggcgcacccugcggguccucaagaugguggagcccuggcugcgcggcaaccaguucugcaucaagauccugaaccccuacaugcccagcguggucgagacgcucgagcagaugcagcggaagcacggcgggaugcuggugcgcaacccgcugucccggaacagcacccacgagauguacuggguguccugcggcaccgggaacaucgucagcgccgugaacaugaccucccgcaugcuccugaaccgguucacgauggcccaccgcaagcccaccuacgagcgcgacguggaccugggcgccggcacccggcacgucgccguggagcccgagguggcgaaccucgacaucaucgggcagcgcaucgagaacaucaagaacgagcacaagagcaccuggcacuacgacgaggacaaccccuacaagacgugggccuaccacggcuccuacgaggucaagccgagcggguccgccagcuccauggugaacggcgucgugaagcugcugaccaagcccugggacgugauccccauggucacccagaucgccaugaccgacacgacccccuucgggcagcagcggguguucaaggagaagguggacacccgcaccccgcgggccaagcgcggcacgacccagaucauggaggucaccgcgaaguggcucuggggcuuccugagccggaacaagaagccccgcaucugcacccgggaggaguucacgcgcaaggugcggagcaacgccgccaucggggccguguucgucgacgagaaccaguggaacuccgccaaggaggcgguggaggacgagcgcuucuggaaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucacggaggacgaccuccagaacgaggccaagaucaccgacaucauggagccggagcacgcgcugcuggccaccuccaucuucaagcucaccuaccagaacaaggugguccgggugcagcgccccgccaagaacggcacggugauggacgucaucagccgccgggaccagcgcggguccggccaggugggcaccuacgggcugaacaccuucaccaacauggaggugcagcugauccggcagauggagagcgagggcaucuuccuccccuccgagcuggagacgcccaaccuggccgagcgcguccucgacuggcuggagaagcacggggccgagcggcugaagcgcauggcgaucagcggcgacgacugcguggugaagccgaucgacgaccgguucgccaccgcccucaccgcccugaacgacauggggaagguccgcaaggacaucccccagugggagcccuccaagggcuggaacgacuggcagcagguccccuucugcagccaccacuuccaccagcugaucaugaaggacggccgggagaucguggucccgugccgcaaccaggacgagcucguggggcgggcccgcgugucccagggcgcgggguggagccugcgggagaccgccugccugggcaaguccuacgcccagauguggcagcucauguacuuccaccgccgggaccugcgccuggccgccaacgcgaucugcagcgccguccccguggacugggugcccaccagccggacgaccugguccauccacgcccaccaccaguggaugaccaccgaggacaugcucagcgucuggaaccgcguguggaucgaggagaaccccuggauggaggacaagacgcacguguccagcugggaggaggucccguaccuggggaagcgggaggaccaguggugcggcucccugaucggccucaccgcccgcgcgaccugggccaccaacauccagguggccaucaaccaggugcgccggcugaucgggaacgagaacuaccuggacuacaugacgagcaugaagcgcuucaagaacgaguccgaccccgagggcgcccucugguga

SEQ ID NO: 8270 - RNA, 9879 nt, Artificial Sequence
  derived and/or modified CDS sequence (opt1) from DENV-1__GU131833__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuuccucacccaggacgagaagggggugacgcagaacggccggcugaucaccgccaacccgaucgucaccgacaaggagaagcccgugaacaucgagaccgagccgcccuucggggaguccuacaucguggucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagguguucggcaccgccuacgggguccuguucuccggcgucagcuggacgaugaagaucgggaucggcauccugcugaccuggcucggccugaacucccgcagcaccucccugagcaugaccugcaucgccguggggauggugacgcucuaccugggcgucauggugcaggccgacuccgggugcgugaucaacuggaagggccgggagcugaagugcgggagcggcaucuucgucaccaacgaggugcacaccuggaccgagcaguacaaguuccaggccgacuccccgaagcgccucagcgcggccaucggcaaggccugggaggagggggugugcggcauccggagcgccacccgccuggagaacaucauguggaagcagaucuccaacgagcugaaccacauccuccuggagaacgacaugaaguucacggucguggugggggacgccaacggcauccuggcgcaggggaagaagaugauccggccccagcccauggagcacaaguacagcuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcucaagcugcgggacagcuacacccagaugugcgaccaccgccugauguccgcggccaucaaggacagcaaggccgugcacgccgacaugggcuacuggaucgaguccgagaagaacgagaccuggaagcucgcccgggcgagcuucaucgaggugaagacgugcaccuggcccaagucccacacccuguggagcaacggcguccuggaguccgagaugaucauccccaagaucuacgggggcccgaucagccagcacaacuaccgccccggguacuucacccagacggccggccccuggcaccucgggaagcuggagcuggacuucgaccucugcgagggcaccaccgugguggucgacgagcacugcggcaaccgggggccgucccugcgcaccacgaccgugaccggcaagaucauccacgaguggugcugccggagcugcacccugccgccccuccgcuuccgcggggaggacggcugcugguacgggauggagauccgccccgugaaggagaaggaggagaaccugguccgguccauggugagcgccggcuccggcgagguggacagcuucagccuggggauccucugcgucuccaucaugaucgaggaggugaugcgcagccgguggucccgcaagaugcugaugacgggcacccuggccguguuccuccugcugaucauggggcagcucaccuggaacgaccugauccgccugugcaucauggucggcgccaacgcgagcgaccggauggggaugggcaccacguaccucgcccugauggccaccuucaagaugcgcccgauguucgccguggggcuccucuuccggcgccugaccucccgggaggugcugcuccugaccaucgggcugagccucgucgccuccguggagcugcccaacagccuggaggagcucggcgacgggcuggcgaugggcaucaugaugcugaagcuccugacggaguuccagccccaccagcuguggaccacccuccugucccugaccuucaucaagacgacccucagccuggacuacgccuggaagaccaccgccauggcccuguccaucgucagccucuucccccugugccuguccacgaccagccagaagaccaccuggcucccggugcugcugggcuccuucgggugcaagccccucaccauguuccugaucacggagaacaagaucuggggccgcaagagcuggccccugaacgaggggaucauggcgaucggcaucguguccauccuccugagcucccugcucaagaacgacgucccccuggccgggccgcugaucgccggcggcaugcucaucgccugcuacgugaucagcgggagcuccgccgaccugagccuggagaaggcggccgagguguccugggagcaggaggccgagcacagcggcaccucccacaacauccucgucgaggugcaggacgacgggaccaugaagaucaaggacgaggagaaggacgacacccugacgauccugcucaaggccacccugcuggccgugagcggcgucuaccccauguccauccccgcgacccucuucgugugguacuucuggcagaagaagaagcagcggagcggggugcugugggacacccccuccccgcccgaggucgagcgcgccgugcuggacgacggcaucuaccggauccugcagcgcggccuccuggggcggagccaggugggcgucgggguguuccagaacggcguguuccacacgauguggcacgucacccgcggggccgugcugauguaccagggcaagcggcucgagcccuccugggccagcgugaagaaggaccugaucuccuacggcgggggcuggcgcuuccaggggagcuggaacaccggcgaggagguccaggugaucgccguggagcccgggaagaacccgaagaacguccagaccacgcccggcaccuucaagacccccgagggcgaggugggggcgaucgcccuggacuucaagcccggcaccuccgggagcccgaucgugaaccgggagggcaagaucgucggccucuacgggaacggcguggugacgaccuccgggaccuacgucagcgccaucgcccaggccaaggcgucccaggagggcccccugcccgagaucgaggacgagguguucaagaagcgcaaccugaccaucauggaccuccacccggggagcggcaagacgcggcgcuaccugcccgccaucgugcgggaggccaucaagcgcaagcugcggacccucauccuggcccccacccgcgucguggcgagcgagauggccgaggcccugaagggcaugcccauccgcuaccagaccacggccgugaaguccgagcacaccgggcgggagaucgucgaccucaugugccacgccaccuucaccaugcgccugcugagcccggugcgggugcccaacuacaacaugaucaucauggacgaggcgcacuucacggaccccgccuccaucgccgcccgcggcuacaucagcacccgggucgggaugggcgaggccgcggccaucuucaugaccgccacgccgcccggguccguggaggccuucccccagagcaacgccgugauccaggacgaggagcgcgacauccccgagcgguccuggaacagcggcuacgacuggaucacggacuuccccggcaagaccgucugguucgugcccuccaucaagagcgggaacgacaucgcgaacugccuccgcaagaacggcaagcgggugauccagcugucccgcaagaccuucgacaccgaguaccagaagacgaagaacaacgacugggacuacgucgugaccaccgacaucagcgagaugggggccaacuuccgggccgaccgcgugaucgacccccggcgcugccugaagcccgucauccucaaggacggccccgagcgggugauccuggccgggccgaugcccgugaccgucgcguccgccgcccagcgccggggccgcaucggccggaaccagaacaaggagggggaccaguacguguacaugggccagccccugaacaacgacgaggaccacgcccacuggacggaggccaagaugcuccuggacaacaucaacacccccgaggggaucaucccggcgcuguucgagcccgagcgcgagaaguccgccgccaucgacggcgaguaccgccuccgcggggaggcccgcaagaccuucgucgagcugaugcggcgcggcgaccugcccguguggcucuccuacaagguggccagcgagggcuuccaguacuccgaccggcgcuggugcuucgacggggagcggaacaaccagguccuggaggagaacauggacguggagaucuggaccaaggagggcgagcgcaagaagcugcggccccgcuggcucgacgcgcggaccuacagcgacccgcuggcccugcgcgaguucaaggaguucgccgccgggcggcgcuccgugagcggcgaccucauccuggagaucggcaagcugccccagcaccucacgcugcgggcccagaacgcgcuggacaaccucgucaugcugcacaacagcgagcagggcgggaaggccuaccgccacgccauggaggagcugcccgacaccaucgagacccucaugcugcuggcccucaucgcggugcugaccgggggcgugacgcuguucuuccucuccgggaagggccugggcaagaccagcaucgggcugcucugcgucaccgccuccagcgcccugcuguggauggccuccguggagccccacuggaucgccgcgagcaucauccucgaguucuuccugauggugcugcucaucccggagcccgaccggcagcgcacgccccaggacaaccagcuggccuacgucgugaucggccuccucuucaugauccugacgguggccgccaacgagauggggcugcucgagaccaccaagaaggaccugggcaucgggcacgucgccgcggagaaccaccagcacgccaccaugcuggacguggaccuccggccggccuccgccuggacgcuguacgccguggcgaccaccgucaucacccccaugaugcgccacacgaucgagaacaccaccgccaacaucagccugaccgccaucgccaaccaggccgcgauccucaugggccuggacaagggcuggcccaucuccaagauggacaucggggugccccugcucgcccugggcugcuacagccaggugaacccgcugacgcucaccgccgccguccugaugcugguggcgcacuacgccaucaucgggcccggccuccaggccaaggccacccgggaggcccagaagcgcaccgcggccgggaucaugaagaaccccacgguggacggcaucgucgccaucgaccuggaccccgugguguacgacgccaaguucgagaagcagcugggccagaucaugcuccugauccugugcaccucccagauccuccugaugcgcaccaccugggcccugugcgagagcaucacgcucgcgaccgggccgcugaccacccugugggagggcucccccgggaaguucuggaacacgaccaucgccgucagcauggccaacaucuuccggggcuccuaccucgccggcgccgggcuggcguucagccugaugaagucccucggcgggggccgccgggggaccggcgcccagggcgagacccugggggagaaguggaagcgccagcugaaccagcucagcaaguccgaguucaacacguacaagcggagcggcaucauggagguggaccgcagcgaggccaaggaggggcugaagcggggcgagaccaccaagcacgccgugucccgcgggaccgcgaagcugcggugguucgucgagcgcaaccuggugaagcccgagggcaaggugaucgaccucggcugcgggcggggcggguggagcuacuacugcgccggccugaagaaggucaccgaggugaagggguacacgaagggcggccccgggcacgaggagccgauccccauggccaccuacggcuggaaccuggugaagcuccacuccgggaaggacgucuucuucaugccgcccgagaagugcgacacccugcugugcgacaucggcgagagcuccccgaaccccaccaucgaggaggggcgcacgcuccgggugcugaagaugguggagcccuggcugcgcggcaaccaguucugcaucaagauccucaaccccuacaugccgagcgucguggagacccuggagcagaugcagcggaagcacggcgggaugcuggugcgcaacccccucucccggaacagcacccacgagauguacugggucuccugcggcaccgggaacaucgugagcgccgugaacaugacgucccgcaugcugcugaaccgguucaccauggcccaccgcaagcccaccuacgagcgcgacgucgaccucggcgcgggcacccggcacguggccguggagcccgaggucgccaaccuggacaucaucgggcagcgcaucgagaacaucaagaacgagcacaagagcacguggcacuacgacgaggacaacccguacaagaccugggccuaccacggcuccuacgaggugaagcccagcggguccgccagcuccauggugaacggcgucgugcggcugcucaccaagcccugggacgucauccccauggugacccagaucgcgaugacggacaccaccccguucgggcagcagcgcguguucaaggagaaggucgacacccggacgccccgcgccaagcggggcaccacccagaucauggaggugaccgcccgcuggcuguggggcuuccugagccggaacaagaagccccgcaucugcacgcgggaggaguucacccgcaaggugcgguccaacgccgccaucggggcggucuucguggacgagaaccaguggaacagcgccaaggaggccguggaggacgagcgcuucugggaccucguccaccgggagcgcgagcugcacaagcagggcaagugcgcgaccugcguguacaacaugauggggaagcgggagaagaagcugggcgaguucgggaaggcgaagggcagccgcgccaucugguacauguggcucggcgcccgguuccuggaguucgaggcccugggguucaucaacgaggaccacugguucucccgcgagaacagccucuccggcguggagggggagggccugcacaagcugggguacauccuccgggacaucagcaagaucccgggcggcaacauguacgccgacgacaccgcggggugggacacgcgcaucaccgaggacgaccugcagaacgaggccaagaucaccgacaucauggagcccgagcacgcccugcucgccaccuccaucuucaagcugacguaccagaacaaggucgugcgcgugcagcggcccgccaagaacggcaccgucauggacgugaucagccgccgggaccagcgcggguccggccaggugggcaccuacgggcugaacaccuucacgaacauggagguccagcucauccggcagauggagagcgagggcaucuuccugcccuccgagcuggagaccccgaaccucgcggagcgcgugcuggacuggcuggagaagcacggggccgagcggcucaagcgcauggccaucagcggcgacgacugcguggucaagcccaucgacgaccgguucgccaccgcccugaccgcgcugaacgacauggggaaggugcgcaaggacaucccccagugggagcccuccaagggcuggaacgacuggcagcaggucccguucugcagccaccacuuccaccagcucaucaugaaggacggccgggagaucgucgugcccugccgcaaccaggacgagcugguggggcgggcccgcgucucccagggcgccggguggagccugcgggagaccgccugccucggcaaguccuacgcccagauguggcagcugauguacuuccaccgccgggaccugcgccucgcggccaacgccaucugcagcgccgugcccguggacuggguccccacgucccggaccaccuggagcauccacgcgcaccaccaguggaugaccacggaggacaugcugagcguguggaaccgcguguggaucgaggagaacccguggauggaggacaagacccacgucuccagcugggaggaggugcccuaccuggggaagcgcgaggaccaguggugcggcucccucaucggccugaccgcccgggccaccugggccacgaacauccagguggccaucaaccagguccgccggcugaucgggaacgagaacuaccucgacuacauggcgagcaugaagcgcuucaagaacgaguccgaccccgagggcgcccugugguga

SEQ ID NO: 8271 - RNA, 9879 nt, Artificial Sequence
  derived and/or modified CDS sequence (opt1) from DENV-1__GU131834__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaagacccugaagcuguccugguucaagaaggggagcuccaucggcaagauguucgaggcgacggcccgcggggcccggcgcauggccauccucggcgacaccgccugggacuucgggagcaucggcggcguguucaccuccguggggaagcugguccaccagguguucggcaccgcguacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgccgcgaucggcaaggccugggaggagggggugugcggcauccgguccgccacccgccucgagaacaucauguggaagcagaucagcaacgagcugaaccacauccugcucgagaacgacaugaaguucacggucguggugggggacgccaacggcauccuggcccaggggaagaagaugauccggccccagcccauggagcacaaguacuccuggaaguccuggggcaaggcgaagaucaucggcgccgacauccagaacaccaccuucaucaucgacgggcccgacaccccggagugccccgacggccagcgcgccuggaacaucugggaggucgaggacuacggguucggcaucuucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggugaagacgugcaccuggcccaagagccacacccucugguccaacgggguccuggagagcgagaugaucauccccaagaucuacggcgggccgaucucccagcacaacuaccgccccggcuacuucacccagacggcggggcccuggcaccugggcaagcucgagcuggacuucgaccugugcgagggcaccaccgugguggucgacgagcacugcgggaaccggggcccgagccuccgcaccacgaccgugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugacggggacccuggccguguuccugcuccugaucaugggccagcugaccuggaacgaccucauccgccugugcaucauggucggggccaacgccuccgaccggaugggcaugggcaccacguaccuggcgcucauggccaccuucaagaugcgcccgauguucgccguggggcugcuguuccggcgccucaccagccgggaggugcugcugcucaccaucgggcugucccuggucgccagcguggagcuccccaacucccuggaggagcugggggacggccucgccaugggcaucaugaugcugaagcugcucacggaguuccagccccaccagcuguggaccacccugcucagccugaccuucgucaagacgacccugucccucgacuacgcguggaagaccaccgccauggugcugagcaucgugucccuguucccccucugccugagcacgaccucccagaagaccaccuggcugccgguccuccuggggagcuucggcugcaagccccugaccauguucuucaucacggagaacaagaucugggggcgcaaguccuggccccucaacgagggcaucauggccaucgggaucgugagcauccugcuguccagccuccugaagaacgacgugccccuggccggcccgcucaucgcgggcgggaugcugaucgccugcuacgucaucagcggcuccagcgccgaccugucccucgagaaggccgccgaggugagcugggagcaggaggcggagcacuccggggccagccacaacauccugguggagguccaggacgacggcaccaugaagaucaaggacgaggagcgggacgacacccugaccauccuccugaaggccacgcugcucgccguguccgggguguaccccaugagcauccccgccacccuguucgucugguacuucuggcagaagaagaagcagcgcuccggcgugcugugggacacccccagcccgcccgagguggagcgggcgguccucgacgacggcaucuaccgcauccugcagcgggggcugcugggccgcucccaggugggggugggcgucuuccaggacgggguguuccacaccauguggcacgugacgcggggcgccguccucauguaccagggcaagcgccuggagcccagcugggccuccgugaagaaggaccugaucagcuacgggggcggguggcgguuccagggcuccuggaacaccggggaggaggugcaggucaucgccguggagcccggcaagaacccgaagaacgugcagaccacccccggcacguucaagacccccgagggggaggucggcgccaucgcgcucgacuucaagcccgggaccagcggcuccccgaucgugaaccgcgagggcaagaucguggggcuguacggcaacggggucgugaccacgagcggcaccuacguguccgccaucgcccaggccaaggccagccaggaggggccccugcccgagaucgaggacgaggucuucaagaagcggaaccucaccaucauggaccugcacccgggcagcggcaagacccgccgguaccugcccgcgaucgugcgcgaggccaucaagcggaagcuccgcacgcugauccuggcccccacccgcguggucgccuccgagauggcggaggcccucaaggggaugcccauccgguaccagaccaccgccgucaagagcgagcacacgggccgcgagaucguggaccugaugugccacgccaccuucaccaugcggcugcucuccccgguccgcgugcccaacuacaacaugaucaucauggacgaggcccacuucaccgaccccgcgagcaucgccgcccggggguacaucuccacgcgcgugggcaugggggaggccgccgcgaucuucaugaccgccacgccgcccggcagcgucgaggccuucccccaguccaacgccgugauccaggacgaggagcgggacauccccgagcgcagcuggaacuccggcuacgacuggaucaccgacuuccccgggaagacggugugguucguccccagcaucaaguccggcaacgacaucgccaacugccugcggaagaacgggaagcgcgugauccagcugagccggaagaccuucgacaccgaguaccagaagaccaagaacaacgacugggacuacguggucacgaccgacaucuccgagaugggcgcgaacuuccgcgccgaccgggugaucgacccccgccggugccucaagcccgugauccugaaggacgggcccgagcgcgucauccuggccggcccgaugcccgugaccgucgccagcgcggcccagcggcgcggccggaucgggcgcaaccagaacaaggagggcgaccaguacguguacauggggcagccccucaacaacgacgaggaccacgcccacuggaccgaggccaagaugcugcuggacaacaucaacacgcccgagggcaucaucccggcccucuucgagcccgagcgcgagaaguccgcggccaucgacggggaguaccggcugcgcggcgaggcccggaagaccuucguggagcugaugcgccggggcgaccuccccgucuggcugagcuacaagguggccuccgagggguuccaguacagcgaccgccgguggugcuucgacggcgagcgcaacaaccaggugcuggaggagaacauggacgucgagaucuggaccaaggagggggagcggaagaagcuccgcccccgguggcuggacgcccgcaccuacuccgacccgcuggcgcuccgggaguucaaggaguucgccgccggccgccggagcgugagcggcgaccugauccuggagaucgggaagcucccccagcaccugacccugcgcgcccagaacgcccucgacaaccuggugaugcugcacaacuccgagcagggcgggaaggcguaccggcacgccauggaggagcuccccgacacgaucgagacccugaugcugcucgcccugaucgccguccugaccggcggggugacccucuucuuccugagcggcaagggccuggggaagacguccaucggccuccugugcgugaccgcgagcuccgcccugcucuggauggccagcgucgagccccacuggaucgccgccuccaucauccuggaguucuuccugauggugcuccugaucccggagcccgaccgccagcggacgccccaggacaaccagcuggcguacguggucaucgggcuccuguucaugauccugaccguggccgccaacgagaugggccuccuggagacgaccaagaaggaccuggggaucggcuacguggccgccgagaaccaccagcacgcgaccaugcucgacgucgaccugcgcccggccagcgccuggacccuguacgccguggccacgaccgugaucacccccaugaugcggcacaccaucgagaacacgaccgcgaacaucucccucaccgccaucgccaaccaggccgccauccugaugggccuggacaagggguggcccaucagcaagauggacaucggcgucccccuccuggcgcuggggugcuacucccaggugaacccgcucacccugacggccgccgugcugaugcucgucgcccacuacgcgaucaucggccccgggcugcaggccaaggccacccgcgaggcccagaagcgcaccgccgcgggcaucaugaagaaccccaccguggacggcaucguggccaucgaccuggaccccgucguguacgacgccaaguucgagaagcagcucgggcagaucaugcugcugauccucugcacgagccagauccugcugaugcggaccaccugggcccucugcgaguccaucacccuggccacgggcccgcugaccacccucugggaggggagccccggcaaguucuggaacaccacgaucgcgguguccauggccaacaucuuccgcggcagcuaccuggccggggccggccuggccuucucccucaugaagucccucgggggcgggcggcgcgggaccggcgcgcagggggagacccugggcgagaaguggaagcggcagcucaaccagcuguccaagagcgaguucaacaccuacaagcgcagcgggaucauggaggucgaccgguccgaggccaaggagggccugaagcgcggggagacgaccaagcacgccgugagccggggcaccgccaagcuccgcugguucguggagcggaaccuggucaagcccgagggcaaggugaucgaccuggggugcggccgcgggggcugguccuacuacugcgcggggcugaagaaggugaccgaggucaagggcuacaccaagggcgggcccggccacgaggagccgauccccauggccacguacggguggaaccucgugaagcugcacagcggcaaggacguguucuucaugccgcccgagaagugcgacacccugcucugcgacaucggggaguccagcccgaaccccaccaucgaggagggccggacccugcgcguccugaagaugguggagcccuggcuccggggcaaccaguucugcaucaagauccugaaccccuacaugccguccguggucgagacgcuggagcagaugcagcgcaagcacgggggcaugcucgugcggaacccccugagccgcaacuccacccacgagauguacugggugagcugcgggaccggcaacaucgucuccgccgugaacaugaccagccggaugcugcucaaccgcuucacgauggcccaccgcaagcccaccuacgagcgggacguggaccugggcgccgggacccgccacgucgcgguggagcccgagguggccaaccuggacaucaucggccagcggaucgagaacaucaagaacgagcacaaguccaccuggcacuacgacgaggacaacccguacaagacgugggccuaccacgggagcuacgaggucaagcccuccggcagcgccuccagcauggugaacggggucgugcgccuccugaccaagcccugggacgugauccccauggucacccagaucgccaugaccgacacgaccccguucggccagcagcggguguucaaggagaagguggacacccgcacgccccgggcgaagcgcggcacgacccagaucauggaggucaccgccaaguggcuguggggguuccucucccggaacaagaagccccgcaucugcacccgggaggaguucacgcgcaaggugcggagcaacgccgccaucggcgccguguucgucgacgagaaccaguggaacagcgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgccgacgacaccgccggcugggacacccgcaucacggaggacgaccugcagaacgaggcgaagaucaccgacaucauggagcccgagcacgcccuccuggccaccagcaucuucaagcugaccuaccagaacaaggugguccgcgugcagcggcccgccaagaacgggacggugauggacgucaucucccgccgggaccagcgcggcagcggccagguggggaccuacggccucaacaccuucaccaacauggaggugcagcugauccggcagauggaguccgaggggaucuuccugcccagcgagcucgagacgccgaaccuggccgagcgcguccuggacuggcucgagaagcacggcgcggagcggcugaagcgcauggccaucuccggggacgacugcguggugaagcccaucgacgaccgguucgccaccgcccugaccgcccucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcgcgcgugagccagggggccggcuggucccuccgggagaccgccugccugggcaagagcuacgcccagauguggcagcugauguacuuccaccgccgggaccuccgccuggccgcgaacgccaucugcuccgccguccccguggacugggugcccaccagccggacgaccuggagcauccacgcccaccaccaguggaugaccaccgaggacaugcuguccgucuggaaccgcguguggaucgaggagaacccguggauggaggacaagacgcacgugagcuccugggaggagguccccuaccucggcaagcgcgaggaccaguggugcggcagccugaucgggcugaccgcgcgggccaccugggccaccaacauccagguggccaucaaccaggugcgccggcucaucggcaacgagaacuaccuggacuacaugacguccaugaagcgcuucaagaacgagagcgaccccgagggggcccugugguga

SEQ ID NO: 8272 - RNA, 9879 nt, Artificial Sequence
  derived and/or modified CDS sequence (opt1) from DENV-1__GU131835__SS-prME
agcgugaccaugcugcucaugcugcugcccaccgcccucgccuuccaccugaccacccggggcggggagccgcacaugaucgugagcaagcaggagcggggcaagagccuccucuucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggugcugcgccaccccggguucacggugaucgccuucuuccuggcccacgcgaucggcaccagcaucacccagaaggggaucaucuucauccuccugaugcuggucacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggccgaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcucaagcuguccugguucaagaaggggagcuccaucggcaagauguucgaggccacggcccgcggggcccggcgcauggccauccugggcgacaccgcgugggacuucgggagcaucggcggcguguucaccuccguggggaagcucguccaccagguguucggcaccgccuacggggugcuguucagcggcgucuccuggacgaugaagaucgggaucggcauccugcucaccuggcugggccugaacagccgcuccaccagccucuccaugaccugcaucgccguggggauggugacgcuguaccugggcgucauggugcaggccgacagcgggugcgugaucaacuggaagggccgggagcucaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucacggucguggugggggacgccaacggcauccucgcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgaccagcgcgccuggaacaucugggaggucgaggacuacggcuucgggaucuucacgaccaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagacgugcaccuggcccaagagccacacccugugguccaacggcguccucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgugguggucgacgagcacugcggcaaccgggggccgagccugcgcaccacgaccgugaccggcaagaucauccacgaguggugcugccgguccugcacccugccgccccuccgcuuccgcggggaggacggcugcugguacgggauggagauccgccccgugaaggagaaggaggagaaccugguccggagcaugguguccgccggcagcggcgagguggacagcuucucccucgggauccugugcgucagcaucaugaucgaggaggugaugcgcucccgguggagccgcaagaugcugaugacgggcacccucgccguguuccugcugcucaucauggggcagcugaccuggaacgaccugauccgccucugcaucauggucggcgccaacgcguccgaccggauggggaugggcaccacguaccuggcccugauggccaccuucaagaugcgcccgauguucgccgugggccuccuguuccggcgccugaccagccgggaggugcuccugcugaccaucgggcucucccuggucgccagcguggagcugcccaacucccucgaggagcugggcgacgggcuggcgaugggcaucaugaugcucaagcugcugacggaguuccagccccaccagcucuggaccacccugcugagccucaccuucaucaagacgacccugucccuggacuacgccuggaagaccaccgccaugguccucagcaucgugucccuguucccccugugccucagcacgaccucccagaagaccaccuggcugccggugcugcucggcagcuucgggugcaagccccugaccauguuccugaucacggagaacaagaucuggggccgcaaguccuggccccucaacgaggggaucauggccaucggcaucgucagcauccugcuguccagccuccugaagaacgacgugccccuggcggggccgcucaucgccggcggcaugcugaucgccugcuacgugaucagcggguccagcgccgaccugucccucgagaaggccgcggaggucagcugggagcaggaggccgagcacuccggcaccagccacaacauccugguggaggugcaggacgacgggaccaugaagaucaaggacgaggagcgggacgacacccugacgauccuccugaaggccacccugcucgccgucuccggcguguaccccaugagcauccccgccacccuguucgugugguacuucuggcagaagaagaagcagcgcuccgggguccugugggacacccccagcccgcccgagguggagcgggcggugcucgacgacggcaucuaccgcauccugcagcggggccugcuggggcgcucccaggucggcguggggguguuccaggacggcgucuuccacacgauguggcacgugacccgcggggccgugcucauguaccagggcaagcgccuggagcccagcugggccuccgucaagaaggaccugaucagcuacggcgggggcuggcgguuccagggguccuggaacaccggcgaggagguccaggugaucgccgucgagcccgggaagaacccgaagaacgugcagaccacgcccggcaccuucaagacccccgagggcgaggugggggccaucgcgcucgacuucaagcccggcaccagcggguccccgaucgucaaccgcgagggcaagaucgugggccuguacgggaacggcguggucacgaccagcgggaccuacguguccgccaucgcccaggccaaggccagccaggagggcccccugcccgagaucgaggacgagguguucaagaagcggaaccucaccaucauggaccugcacccggggagcggcaagacgcgccgguaccugcccgcgaucguccgcgaggccaugaagcggaagcuccgcacccugauccuggcccccacccgcgugguggccuccgagauggcggaggcccucaagggcaugcccauccgguaccagaccacggccgucaagagcgagcacaccgggcgcgagaucguggaccugaugugccacgccaccuucaccaugcggcugcucuccccggugcgcguccccaacuacaacaugaucaucauggacgaggcccacuucacggaccccgcgagcaucgccgcccggggcuacaucuccacccgcguggggaugggcgaggccgccgcgaucuucaugaccgccacgccgcccgggagcguggaggccuucccccaguccaacgccgucauccaggacgaggagcgggacauccccgagcgcagcuggaacuccggcuacgaguggaucacggacuuccccggcaagaccgugugguucgugcccagcaucaaguccgggaacgacaucgccaacugccugcggaagaacggcaagcgcgucauccagcugagccggaagaccuucgacaccgaguaccagaagacgaagaacaacgacugggacuacguggugaccaccgacaucuccgagaugggggcgaacuuccgcgccgaccgggucaucgacccccgccggugccucaagcccgugauccugaaggacggccccgagcgcgugauccuggccgggccgaugcccgucaccguggccagcgcggcccagcggcgcggccggaucggccgcaaccagaacaaggagggggaccaguacgucuacaugggccagccccucaacaacgacgaggaccacgcccacuggacggaggccaagaugcugcuggacaacaucaacacccccgaggggaucaucccggcccucuucgagcccgagcgcgagaaguccgcggccaucgacggcgaguaccggcugcgcggggaggcccggaagaccuucguggagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcccgcaccuacuccgacccgcuggcgcuccgggaguucaaggaguucgccgccgggcgccggagcgucagcggcgaccugauccuggagaucggcaagcucccccagcaccugacgcugcgcgcccagaacgcccucgacaaccuggugaugcugcacaacuccgagcagggcgggaaggcguaccggcacgccauggaggagcuccccgacaccaucgagacccugaugcugcucgcccugaucgccgugcugaccgggggcgucaugcuguucuuccugagcgggaagggccugggcaagacguccaucgggcuccugugcgugaccgcgagcuccgcccugcucuggauggccagcguggagccccacuggaucgccgccuccaucguccuggaguucuuccugauggugcuccugaucccggagcccgaccgccagcggacgccccaggacaaccagcuggcguacguggucaucggccuccuguucaugauccugaccguggccgccaacgagauggggcuccuggagacgaccaagaaggaccugggcaucgggcacgccgccgcggagaaccaccagcacgccaccaugcucgacguggaccugcgcccggccagcgccuggacccuguacgccgucgcgacgaccgugaucacccccaugaugcggcacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggucaacccgcucacccugacggccgccgugcugaugcucguggcgcacuacgccaucaucgggcccggccugcaggccaaggccacccgcgaggcccagaagcgcaccgcggccgggaucaugaagaaccccaccgucgacggcaucguggccaucgaccuggaccccguggucuacgacgccaaguucgagaagcagcucggccagaucaugcugcugauccucugcacgagccagauccugcugaugcggaccaccugggcccucugcgaguccaucacccuggcgacggggccgcugaccacccucugggagggcagccccgggaaguucuggaacaccacgaucgccguguccauggccaacaucuuccgcggcagcuaccuggccggcgccgggcuggcguucucccucaugaagucccugggcgggggccggcgcgggaccggcgcccagggcgagacccugggggagaaguggaagcggcagcucaaccagcuguccaagcccgaguucaacaccuacaagcgcagcggcaucauggagguggaccggagcgaggccaaggaggggcugaagcgcggcgagacgaccaagcacgccgucucccgggggaccgcgaagcuccgcugguucguggagcggaaccuggugaagcccgagggcaaggucaucgaccugggcugcgggcgcggcggguggagcuacuacugcgccggccugaagaaggugaccgaggugaagggguacaccaagggcggcccggggcacgaggagcccauccccauggccacguacggcuggaaccucgucaagcugcacuccgggaaggacguguucuucaugcccccggagaagugcgacacccugcucugcgacaucggcgagagcucccccaaccccaccaucgaggaggggcggacccugcgcgugcugaagauggucgagcccuggcuccggggcaaccaguucugcaucaagauccugaacccguacaugcccacggugguggagacccuggagcagaugcagcgcaagcacggcgggaugcucguccggaacccccugagccgcaacuccacccacgagauguacugggugagcugcggcaccgggaacaucguguccgccgucaacaugacgagccggaugcugcucaaccgcuucaccauggcccaccgcaagcccaccuacgagcgggacguggaccugggcgcgggcacccgccacguggccgucgagccggagguggccaaccuggacaucaucgggcagcggaucgagaacaucaagaacgagcacaaguccacguggcacuacgacgaggacaaccccuacaagaccugggccuaccacggcagcuacgaggugaagcccuccgggagcgccuccagcauggucaacggcgugguccgccuccugaccaagcccugggacgugaucccgauggugacccagaucgcgaugacggacaccacccccuucgggcagcagcgggucuucaaggagaagguggacacccgcacgccccgggccaagcgcggcaccacccagaucauggaggugaccgccaaguggcuguggggcuuccucucccggaacaagaagccgcgcaucugcacgcgggaggaguucacccgcaagguccggagcaacgccgccaucggggcgguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcagccgcgccaucugguacauguggcugggcgcccgguuccuggaguucgaggcccucggguucaugaacgaggaccacugguucagccgcgagaacucccugagcggcgucgagggggagggccugcacaagcucggguacauccugcgggacaucucccgcauccccggcggcaacauguacgccgacgacaccgcggggugggacacgcgcaucaccgaggacgaccugcagaacgaggccaagaucaccgacaucauggagcccgagcacgcccuccuggccaccagcaucuucaagcugacguaccagaacaagguggugcggguccagcgccccgccaagaacggcaccgugauggacgugaucucccggcgcgaccagcgggggagcggccaggucggcaccuacgggcucaacaccuucacgaacauggaggugcagcugauccgccagauggaguccgagggcaucuuccugccgagcgagcucgagacccccaaccuggcggagcgggugcuggacuggcucgagaagcacggggccgagcgccugaagcggauggccaucuccggcgacgacugcgucgugaagcccaucgacgaccgcuucgccaccagccugaccgcccucaacgacauggggaaggugcggaaggacaucccccagugggagccguccaagggcuggaacgacuggcagcagguccccuucugcagccaccacuuccaccagcugaucaugaaggacggccgcgagaucguggugcccugccggaaccaggacgagcuggucgggcgcgcgcgggugucccagggcgccggguggagccuccgcgagaccgccugccugggcaaguccuacgcccagauguggcagcugauguacuuccaccggcgcgaccuccggcuggccgcgaacgccaucugcagcgccgugcccgucgacugggugccgacgucccgcaccaccuggagcauccacgcccaccaccaguggaugaccacggaggacaugcugagcguguggaaccgcgucuggaucgaggagaaccccuggauggaggacaagacccacguguccagcugggaggaggugcccuaccucgggaagcgggaggaccaguggugcggcucccugaucggccugaccgcgcgcgccaccugggccacgaacauccaggucgccaucaaccaggugcggcgccucaucgggaacgagaacuaccuggacuacaugaccagcaugaagcgguucaagaacgaguccgaccuggagggcgcccucugguga

SEQ ID NO: 8273 - RNA, 9879 nt, Artificial Sequence
  derived and/or modified CDS sequence (opt1) from DENV-1__GU131836__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccggcucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacggucguggugggggacgccaacggcauccugguccaggggaagaagaugauccggccccagcccauggagcacaaguacuccuggaaguccuggggcaaggcgaagaucaucggcgccgacauccagaacaccaccuucaucaucgacgggcccgacaccccggagugccccgacgaccagcgcgccuggaacaucugggagguggaggacuacggcuucgggaucuucacgaccaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcugucccgggccagcuucaucgaggucaagacgugcaccuggcccaagucccacacccucuggagcaacggcgugcuggaguccgagaugaucauccccaagaucuacgggggcccgaucagccagcacaacuaccgccccggguacuucacccagacggccggccccuggcaccuggggaagcucgagcuggacuucgaccugugcgagggcaccaccguggucguggacgagcacugcggcaaccgggggccgucccuccgcaccacgaccgugaccggcaagaucauccacgaguggugcugccggagcugcacccugccgccccugcgcuuccgcggggaggacggcugcugguacgggauggagauccgccccgucaaggagaaggaggagaaccucgugcgguccauggugagcgcgggcagcggcgaggucgacuccuucagccuggggauccugugcguguccaucaugaucgaggaggugaugcgcagccgguggucccgcaagaugcucaugacgggcacccuggccgucuuccugcuccugaucauggggcagcugaccuggaacgaccucauccgccugugcaucauggugggcgccaacgccagcgaccggauggggaugggcaccacguaccuggcccucauggcgaccuucaagaugcgcccgauguucgccguggggcugcuguuccggcgccucaccucccgggagguccugcugcucaccaucgggcugagccugguggccuccgucgagcuccccaacagccuggaggagcugggcgacgggcucgccaugggcaucaugaugcugaagcugcucacggaguuccagccccaccagcuguggaccacccugcucucccugaccuucaucaagacgacccugagccucgacuacgccuggaagaccaccgcgauggcccuguccaucgugagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccaucggcaucgucuccauccugcucagcagccugcugaagaacgacgugccccucgccgggccgcugaucgcgggcggcaugcugaucgccugcuacgugaucuccgggagcuccgccgaccucagccuggagaaggccgccgaggucuccugggagcaggaggcggagcacagcggcaccucccacaacauccugguggaggugcaggacgacgggaccaugaagaucaaggacgaggagaaggacgacacccucacgauccugcugaaggccacccuccuggccgucagcggcguguaccccauguccauccccgccacccuguucgugugguacuucuggcagaagaagaagcagcggagcgggguccucugggacacccccuccccgcccgagguggagcgcgccgugcuggacgacggcaucuaccggauccugcagcgcggccugcucgggcggagccaggucggcguggggguguuccaggacggcgucuuccacacgauguggcacgugacccgcggggcggugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacgcccggcaccuucaagacccccgagggcgaggugggggccaucgcccuggacuucaagcccggcaccuccgggagcccgaucgucaaccgggagggcaagaucgugggccuguacgggaacggcguggucacgaccuccgggaccuacgugagcgcgaucgcccaggccaaggccagccaggagggcccccuccccgagaucgaggacgagguguucaagaagcgcaaccugaccaucauggaccugcacccgggguccggcaagacgcggcgcuaccuccccgccaucguccgggaggcgaucaagcgcaagcugcggacccugauccucgcccccacccgcgugguggccagcgagauggccgaggcgcugaagggcaugcccauccgcuaccagaccacggccgucaaguccgagcacaccgggcgggagaucguggaccugaugugccacgccaccuucaccaugcgccuccugagcccggugcggguccccaacuacaacaugaucaucauggacgaggcccacuucacggaccccgccuccaucgcggcccgcggcuacaucagcacccggguggggaugggcgaggccgccgccaucuucaugaccgcgacgccgcccggguccguggaggccuucccccagagcaacgccgucauccaggacgaggagcgcgacauccccgagcgguccuggaacagcggcuacgacuggaucacggacuuccccggcaagaccgugugguucgugcccuccaucaagagcgggaacgacaucgccaacugccugcgcaagaacggcaagcgggucauccagcucucccgcaagaccuucgacaccgaguaccagaagacgaagaacaacgacugggacuacguggugaccaccgacaucagcgagaugggggccaacuuccgggcggaccgcgucaucgacccccggcgcugccugaagcccgugauccugaaggacggccccgagcgggugauccucgccgggccgaugcccgucaccguggccuccgccgcgcagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgccgcgaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccgcucgcccugcgcgaguucaaggaguucgcggccgggcggcgcagcgucuccggcgaccugauccucgagaucggcaagcugccccagcaccugacgcuccgggcccagaacgcccuggacaaccuggugaugcuccacaacagcgagcagggcgggaaggccuaccgccacgcgauggaggagcugcccgacaccaucgagacccugaugcuccuggcccugaucgccgugcucaccgggggcgucacgcuguucuuccuguccgggaagggccucggcaagaccagcaucgggcugcugugcgugauggccuccagcgcgcuccuguggauggccuccguggagccccacuggaucgccgccagcaucauccuggaguucuuccucaugguccugcugaucccggagcccgaccggcagcgcacgccccaggacaaccagcucgccuacguggugaucggccugcuguucaugauccucaccgucgcggccaacgagauggggcugcuggagacgaccaagaaggaccucggcaucgggcacguggccgccgagaaccaccagcacgccaccaugcuggacguggaccugcggccggcguccgccuggacccucuacgccgucgccacgaccgugaucacccccaugaugcgccacaccaucgagaacacgaccgccaacaucagccugaccgcgaucgccaaccaggccgccauccugaugggccucgacaagggcuggcccaucuccaagauggacaucggggugccccugcuggcccucggcugcuacagccaggucaacccgcugacccugacggcggccgugcucaugcugguggcccacuacgccaucaucgggcccggccugcaggcgaaggccacccgggaggcccagaagcgcaccgccgccgggaucaugaagaaccccaccgucgacggcaucguggcgaucgaccucgaccccguggucuacgacgccaaguucgagaagcagcugggccagaucaugcugcucauccugugcacgucccagauccugcucaugcgcaccaccugggcccugugcgagagcaucacccuggccacggggccgcucaccacccugugggagggcucccccgggaaguucuggaacaccacgaucgccgugagcauggcgaacaucuuccggggcuccuaccuggccggcgccgggcucgccuucagccugaugaagucccugggcgggggccgccgggggaccggcgcccagggcgagacccucggggagaaguggaagcgccagcugaaccagcugagcaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacaccaagggcggccccgggcacgaggagccgauccccauggcgacguacggcuggaaccuggucaagcugcacuccgggaaggacguguucuucaugccgcccgagaagugcgacacccuccugugcgacaucggcgagagcuccccgaaccccaccaucgaggaggggcgcacccugcgggugcucaagauggucgagcccuggcugcgcggcaaccaguucugcaucaagauccugaaccccuacaugccgagcgugguggagacgcucgagcagaugcagcggaagcacggcgggaugcugguccgcaacccccugucccggaacagcacccacgagauguacuggguguccugcggcaccgggaacaucgugagcgccgucaacaugaccucccgcaugcuccugaaccgguucacgauggcccaccgcaagcccaccuacgagcgcgacguggaccugggcgccggcacccggcacguggccgucgagcccgaggugccgaaccucgacaucaucgggcagcgcaucgagaacaucaagaacgagcacaagagcaccuggcacuacgacgaggacaaccccuacaagacgugggcguaccacggcuccuacgaggugaagcccagcggguccgccagcuccauggucaacggcgugguccggcugcugaccaagcccugggacgugaucccgauggugacccagaucgccaugaccgacacgacccccuucgggcagcagcgcgucuucaaggagaagguggacacccggacgccccgggccaagcggggcacgacccagaucauggaggugaccgccaaguggcucuggggcuuccugagccgcaacaagaagccgcggaucugcacccgcgaggaguucacgcggaagguccgcagcaacgcggccaucggggccguguucguggacgagaaccaguggaacuccgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcgucgagggggagggccuccacaagcugggguacauccugcgcgacaucagcaagauccccggcggcaacauguacgccgacgacaccgccgggugggacacccggaucacggaggacgaccuccagaacgaggccaagaucaccgacaucauggagcccggccacgcccugcuggcgaccuccaucuucaagcucaccuaccagaacaagguggugcgcguccagcgccccgccaagaacgggacggugauggacgugaucagccggcgcgaccagcggggcuccggccaggucgggaccuacggccugaacaccuucaccaacauggaggugcagcugauccgccagauggagagcgaggggaucuuccucccguccgagcuggagacgcccaaccuggccgagcgggugcucgacuggcuggagaagcacggcgccgagcgccugaagcggauggccaucagcggggacgacugcgucgugaagcccaucgacgaccgcuucgcgaccgcccucaccgcccugaacgacaugggcaaggugcggaaggacaucccccagugggagccguccaagggcuggaacgacuggcagcagguccccuucugcagccaccacuuccaccagcugaucaugaaggacgggcgcgagaucguggugcccugccggaaccaggacgagcucgucggccgcgcccgggugucccagggggccggcuggagccugcgcgagaccgcgugccuggggaaguccuacgcccagauguggcagcucauguacuuccaccggcgcgaccugcggcuggccgccaacgccaucugcagcgcggugcccgucgacugggugccgaccagccgcacgaccugguccauccacgcccaccaccaguggaugaccaccgaggacaugcucagcguguggaaccgggucuggaucgaggagaaccccuggauggaggacaagacgcacguguccagcugggaggaggugcccuaccugggcaagcgcgaggaccaguggugcggcucccugaucgggcucaccgcccgcgccaccugggcgaccaacauccaggucgccaucaaccaggugcggcgccugaucggcaacgagaacuaccuggacuacaugacgagcaugaagcgguucaagaacgaguccgaccccgagggggcccucugguga

SEQ ID NO: 8274 - RNA, 9879 nt, Artificial Sequence
  derived and/or modified CDS sequence (opt1) from DENV-1__GU131837__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcgcccggccagcgccuggacccucuacgccguggcgaccacggugaucacccccaugaugcggcacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccggacccugcgcguccucaagaugguggagcccuggcugcggggcaaccaguucugcaucaagauccugaaccccuacaugccguccguggucgagacccucgagcagaugcagcgcaagcacgggggcaugcuggugcggaacccccugagccgcaacuccacgcacgagauguacugggugagcugcgggaccggcaacaucgucuccgccgugaacaugaccagccggaugcuccugaaccgcuucaccauggcccaccgcaagcccacguacgagcgggacguggaccugggcgcggggacccgccacgucgccguggagcccgaggaggccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacggggugguccgccugcugacgaagcccugggacgugauccccauggugacccagaucgcgaugaccgacaccacgccguucggccagcagcgggucuucaaggagaagguggacacccgcacgccccgggccaagcgcggcaccacgcagaucauggaggugaccgccaaguggcucuggggguuccugucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccuggugcaccgggagcgcgagcuccacaagcaggggaagugcgccacgugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaagguggugcgcguccagcggcccgccaagaacgggaccgugauggacgugaucucccgccgggaccagcgcggcagcggccaggucgggacguacggccugaacaccuucaccaacauggaggugcagcugauccggcagauggaguccgaggggaucuuccuccccagcgagcuggagaccccgaaccuggcggagcgcgugcucgacuggcuggagaagcacggcacggagcggcugaagcgcauggccaucuccggggacgacugcgucgugaagcccaucgacgaccgguucgccaccgcccucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcucgucggccgggcgcgcgugagccagggggccggcuggucccugcgggagaccgccugccugggcaagagcuacgcccagauguggcagcucauguacuuccaccgccgggaccugcgccuggccgcgaacgccaucugcuccgccgugcccgucgacugggugcccaccagccggacgaccuggagcauccacgcccaccaccaguggaugaccaccgaggacaugcucuccguguggaaccgcgucuggaucgaggagaacccguggauggaggacaagacgcacgugagcuccugggaggaggugcccuaccugggcaagcgcgaggaccaguggugcggcagccugaucgggcucaccgcgcgggccaccugggccaccaacauccaggucgccaucaaccaggugcgccggcugaucggcaacgagaacuaccuggacuacaugacguccaugaagcgcuucaagaacgagagcgaccccgagggggcccucugguga

SEQ ID NO: 8275 - RNA, 9879 nt, Artificial Sequence
  derived and/or modified CDS sequence (opt1) from DENV-1__JN819415__SS-prME
agcgugaccaugcugcucaugcugcugcccaccgcccucgccuuccaccugacgacccggggcggggagccccacaugaucgugagcaagcaggagcggggcaagagccuccuguucaagaccagcgccggggugaacaugugcacccugaucgccauggaccugggcgagcucugcgaggacacgaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaccgcccuguuccucgcgcacgccaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaagaacaagcccacgcucgacaucgagcugcugaagaccgaggucaccaaccccgcggugcuccggaagcugugcaucgaggccaagaucagcaacaccacgaccgacucccgcugccccacccagggcgaggccacccugguggaggagcaggacgccaacuucgucugccggcgcacguucguggaccggggcugggggaacggcugcggccucuucggcaaggggagccugcugaccugcgccaaguucaagugcgugaccaagcucgagggcaagaucguccaguacgagaaccugaaguacuccgugaucgugaccguccacacgggcgaccagcaccagguggggaacgagaccaccgagcacggcaccaucgcgaccaucacgccccaggcccccaccagcgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcaccuccuacgucaugugcacggggagcuucaagcuggagaaggagguggcggagacccagcacggcaccgugcugguccaggugaaguacgagggcaccgacgcccccugcaagauccccuucuccacgcaggacgagaagggggugacccagaacggccggcucaucaccgccaacccgaucgucaccgacaaggagaagcccgugaacaucgagacggagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacaccgcgugggacuucgggagcaucggcggcguguucaccuccguggggaagcugguccaccagguguucggcacggccuacggggugcuguucagcggcgucuccuggaccaugaagaucgggaucggcauccuccugaccuggcugggccucaacagccgcuccaccagccuguccaugacgugcaucgccguggggauggugacccuguaccucggcgucauggugcaggccgacagcgggugcgugaucaacuggaagggccgggagcugaagugcggguccggcaucuucgucaccaacgaggugcacaccuggaccgagcaguacaaguuccaggccgacagcccgaagcgccugagcgcggccaucggcaaggccugggaggagggggugugcggcauccgguccgccacgcgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacacgccggagugccccgacgaccagcgcgccuggaacaucugggaggucgaggacuacggcuucgggaucuucaccaccaacaucuggcugaagcuccgggacuccuacacccagaugugcgaccaccgccugaugagcgcggccaucaaggacuccaaggccgugcacgccgacaugggcuacuggaucgagagcgagaagaacgagacguggaagcuggcccgggcguccuucaucgaggugaagaccugcaccuggcccaagagccacacccucugguccaacggcguccuggagagcgagaugaucauccccaagaucuacgggggcccgaucucccagcacaacuaccgccccggguacuucacgcagaccgccggccccuggcaccuggggaagcucgagcuggacuucaaccugugcgagggcaccaccgugguggucgacgagcacugcggcaaccgggggccgagccuccgcacgaccaccgugaccggcaagaucauccacgaguggugcugccgguccugcacgcugccgccccugcgcuuccgcggggaggacggcugcugguacgggauggagauccgccccgugaaggagaaggaggagaaccucguccggagcaugguguccgccggcagcggcgagguggacagcuucucccuggggauccugugcgucagcaucaugaucgaggaggugaugcgcucccgguggagccgcaagaugcucaugaccggcacccuggccguguuccugcuccugaucauggggcagcugaccuggaacgaccucauccgccugugcaucauggucggcgccaacgcguccgaccggauggggaugggcacgaccuaccuggcccucauggccaccuucaagaugcgcccgauguucgccgugggccugcuguuccggcgccucaccagccgggaggugcugcugcucacgaucgggcugucccuggucgccagcguggagcuccccaacucccuggaggagcugggcgacgggcucgcgaugggcaucaugaugcugaagcugcucaccgaguuccagccccaccagcuguggaccacccugcucagccugacguucaucaagaccacccugucccucgacuacgccuggaagaccacggccauggcccugagcaucgucucccuguucccccucugccugagcaccaccucccagaagaccaccuggcugccggugcuccugggcagcuucgggugcaagccccugacgauguuccucaucaccgagaacaagaucuggggccgcaaguccuggccccugaacgaggggaucauggcgaucggcaucgugagcauccugcucuccagccugcugaagaacgacgucccccucgccgggccgcugaucgccggcggcaugcugaucgccugcuacgugaucagcggguccagcgccgaccucucccuggagaaggcggccgaggugagcugggagcaggaggccgagcacuccggcaccagccacaacauccuggucgaggugcaggacgacgggaccaugaagaucaaggacgaggagaaggacgacacgcucaccauccugcugaaggccacccuccuggccguguccggcgucuaccccaugagcauccccgcgacccuguucgugugguacuucuggcagaagaagaagcagcgguccggggugcucugggacacgcccagcccgcccgaggucgagcgcgccgugcuggacgacggcaucuaccggauccugcagcgcggccugcucgggcggucccaggugggcgucgggguguuccaggacggcguguuccacaccauguggcacgucacccgcggggccgugcugauguaccagggcaagcggcuggagcccagcugggccuccgugaagaaggaccucaucagcuacggcgggggcuggcgcuuccagggguccuggaacaccggcgaggagguccaggugaucgccguggagcccgggaagaacccgaagaacguccagacgacccccggcaccuucaagacccccgagggcgaggugggggcgaucgcccuggacuucaagcccggcacgagcggguccccgaucgugaaccgggagggcaagaucgucggccuguacgggaacggcguggugaccaccagcgggaccuacgucuccgccaucgcccaggccaaggcgagccaggagggcccccuccccgagaucgaggacgagguguucaagaagcgcaaccugacgaucauggaccugcacccggggagcggcaagacccggcgcuaccuccccgccaucgugcgggaggccaucaagcgcaagcugcggacccugauccucgcccccacccgcgucguggcguccgagauggccgaggcccugaagggcaugcccauccgcuaccagacgaccgccgucaagagcgagcacaccgggcgggagaucgucgaccugaugugccacgccaccuucacgaugcgccuccuguccccggugcgggugcccaacuacaacaugaucaucauggacgaggcgcacuucaccgaccccgccagcaucgccgcccgcggcuacaucuccacccgggucgggaugggcgaggccgcggccaucuucaugaccgccacgcccccggggagcguggaggccuucccccaguccaacgccgugauccaggacgaggagcgcgacauccccgagcggagcuggaacuccggcuacgacuggaucaccgacuuccccggcaagaccgucugguucgugccgagcaucaaguccgggaacgacaucgcgaacugccugcgcaagaacggcaagcgggugauccagcucagccgcaagaccuucgacacggaguaccagaagaccaagaacaacgacugggacuacgucgugaccaccgacaucuccgagaugggggccaacuuccgggccgaccgcgugaucgacccccggcgcugccugaagcccgucauccugaaggacggccccgagcgggugauccucgccgggccgaugcccgugacggucgcgagcgccgcccagcgccggggccgcaucggccggaaccagaacaaggagggggaccaguacguguacaugggccagccccugaacaacgacgaggaccacgcccacuggaccgaggccaagaugcugcucgacaacaucaacacccccgaggggaucaucccggcgcuguucgagcccgagcgcgagaaguccgccgccaucgacggcgaguaccgccugcgcggggaggcccgcaagaccuucgucgagcucaugcggcgcggcgaccugcccguguggcugagcuacaagguggccuccgagggcuuccaguacagcgaccggcgcuggugcuucgacggggagcggaacaaccagguccucgaggagaacauggacguggagaucuggaccaaggagggcgagcgcaagaagcugcggccccgcuggcuggacgcgcggacguacuccgacccgcucgcccugcgcgaguucaaggaguucgccgccgggcggcgcagcgugagcggcgaccugauccucgagaucggcaagcugccccagcaccugacccuccgggcccagaacgcgcuggacaaccuggucaugcuccacaacuccgagcagggcgggaaggccuaccgccacgccauggaggagcugcccgacaccaucgagacccugaugcuccuggcccugaucgcggugcucaccggcggggugacccuguucuuccugagcgggaaggggcucggcaagaccuccaucgggcugcugugcgucaccgccagcuccgcccuccuguggauggccagcguggagccccacuggaucgccgcguccaucauccuggaguucuuccucauggugcugcugaucccggagcccgaccggcagcgcacgccccaggacaaccagcucgccuacgucgugaucggccugcuguucaugauccucaccguggccgccaacgagauggggcugcuggagaccaccaagcgggaccucggcaucgggcacgucgccgcggagaaccaccagcacgccacgaugcuggacguggaccugcgcccggccagcgccuggacccucuacgccguggcgaccaccgucaucacgcccaugaugcggcacaccaucgagaacaccaccgccaacaucucccugacggccaucgccaaccaggccgcgauccugaugggccucgacaagggcuggcccaucagcaagauggacaucggggugccccugcuggcccucggcugcuacucccaggugaacccgcugacccugaccgccgccguccucaugcugguggcgcacuacgccaucaucgggcccggccugcaggccaaggccacccgcgaggcccagaagcgcacggcggccgggaucaugaagaaccccaccguggacggcaucgucgccaucgaccucgaccccgugguguacgacgccaaguucgagaagcagcugggccagaucaugcugcucauccugugcaccagccagauccugcucaugcggaccacgugggcccugugcgaguccaucacccuggcgaccgggccgcucaccacgcugugggagggcagccccgggaaguucuggaacaccaccaucgccgucuccauggccaacaucuuccgcggcagcuaccuggccggcgccgggcucgcguucucccugaugaagucccugggcgggggccggcgcgggaccggcgcccagggcgagacgcucggggagaaguggaagcggcagcugaaccagcuguccaagagcgaguucaacaccuacaagcgcagcggcaucauggagguggaccgguccgaggccaaggaggggcucaagcgcggcgagaccaccaagcacgccgugagccgggggaccgcgaagcugcgcugguucgucgagcggaaccuggugaagcccgagggcaaggugaucgaccugggcugcgggcgcggcgggugguccuacuacugcgccggccucaagaaggucacggaggugaagggguacaccaagggcggccccgggcacgaggagccgauccccauggccaccuacggcuggaaccuggugaagcugcacagcgggaaggacgucuucuucaugccgcccgagaagugcgacacccuccugugcgacaucggcgaguccagcccgaaccccacgaucgaggaggggcggacccugcgcgugcucaagaugguggagcccuggcugcggggcaaccaguucugcaucaagauccugaaccccuacaugccguccgucguggagacccucgagcagaugcagcgcaagcacggcgggaugcuggugcggaacccccugagccgcaacuccacccacgagauguacugggucagcugcggcacggggaacaucguguccgccgugaacaugaccagccggaugcuccugaaccgcuucaccauggcccaccgcaagcccaccuacgagcgggacgucgaccugggcgcgggcacgcgccacguggccguggagcccgaggucgccaaccucgacaucaucgggcagcggaucgagaacaucaagaacgagcacaaguccaccuggcacuacgacgaggacaacccguacaagaccugggccuaccacggcagcuacgaggugaagcccuccgggagcgccuccagcauggugaacggcgucgugcgccugcugaccaagcccugggacgucauccccauggugacgcagaucgcgaugaccgacaccaccccguucgggcagcagcggguguucaaggagaaggucgacacgcgcacgccccgggccaagcgcggcaccacccagaucauggaggugacggccaaguggcucuggggcuuccugucccggaacaagaagccccgcaucugcacccgggaggaguucacccgcaaggugcggagcaacgccgccaucggggcggucuucguggacgagaaccaguggaacagcgccaaggaggccguggaggacgagcgcuucugggaccugguccaccgggagcgcgagcuccacaagcagggcaagugcgcgaccugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcguggagggggagggccuccacaagcugggguacauccugcgggacaucuccaagaucccgggcggcaacauguacgccgacgacacggcggggugggacacccgcaucaccgaggacgaccuccagaacgaggccaagaucaccgacaucauggagcccgagcacgcccugcuggccacgagcaucuucaagcucaccuaccagaacaaggucgugcgcgugcagcggcccgccaagaacggcaccgucauggacgugaucucccgccgggaccagcgcgggagcggccaggugggcaccuacgggcugaacacguucaccaacauggagguccagcugauccggcagauggaguccgagggcaucuuccuccccagcgagcuggagaccccgaaccuggcggagcgcgugcucgacuggcuggagaagcacggggccgagcggcugaagcgcauggccaucuccggcgacgacugcguggucaagcccaucgacgaccgguucgccaccgcccucaccgcgcugaacgacauggggaaggugcgcaaggacaucccccagugggagcccagcaagggcuggaacgacuggcagcaggucccguucugcucccaccacuuccaccagcugaucaugaaggacggccgggagaucgucgugcccugccgcaaccaggacgagcucguggggcgggcccgcgucagccagggcgccggguggucccugcgggagacggccugccugggcaagagcuacgcccagauguggcagcucauguacuuccaccgccgggaccugcgccuggcggccaacgccaucugcuccgccgugcccguggacuggguccccaccagccggaccaccuggagcauccacgcgcaccaccaguggaugacgaccgaggacaugcucuccguguggaaccgcguguggaucgaggagaacccguggauggaggacaagacccacgucagcuccugggaggaggugcccuaccuggggaagcgcgaggaccaguggugcggcagccugaucggccucaccgcccgggccacgugggccaccaacauccagguggccaucaaccagguccgccggcugaucgggaacgagaacuaccuggacuacaugaccuccaugaagcgcuucaagaacgagagcgaccccgagggcgcgcucugguga

SEQ ID NO: 8276 - RNA, 9879 nt, Artificial Sequence
  derived and/or modified CDS sequence (opt1) from DENV-1__GU131838__SS-prME
agcgugaccaugcugcucaugcugcugcccaccgcccucgccuuccaccugaccacccgcggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccaccgcccgcggggcccgccgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgguccaccagccucuccaugaccugcaucgccguggggauggugacccuguaccugggcgucauggugcaggccgacagcgggugcgugaucaacuggaagggccgcgagcucaagugcggguccggcaucuucgucacgaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucaccgucguggugggggacgccaacggcauccucgcgcaggggaagaagaugauccgcccccagcccauggagcacaaguacuccuggaaguccuggggcaaggccaagaucaucggcgccgacauccagaacacgaccuucaucaucgacgggcccgacaccccggagugccccgacggccagcgggccuggaacaucugggaggucgaggacuacggguucggcguguucaccacgaacaucuggcugaagcugcgcgacuccuacacccagaugugcgaccaccggcucaugagcgcggccaucaaggacuccaaggccgugcacgccgacaugggcuacuggaucgagagcgagaagaacgagaccuggaagcuggcccgcgcguccuucaucgaggucaagaccugcacguggcccaagagccacacccugugguccaacggggugcucgagagcgagaugaucauccccaagaucuacggcgggccgaucucccagcacaacuaccggcccggcuacuucacccagaccgccgggcccuggcaccugggcaagcuggagcucgacuucgaccugugcgagggcacgaccguggucguggacgagcacugcgggaaccgcggcccgagccugcggaccaccacggugaccgggaagaucauccacgaguggugcugccgcuccugcacccugccgccccugcgguuccgcggcgaggacgggugcugguacggcauggagauccggcccgucaaggagaaggaggagaaccuggugcgcagcaugguguccgccggcagcggggaggucgacagcuucucccucggcauccugugcgugagcaucaugaucgaggaggugaugcggucccgcuggagccgcaagaugcugaugaccgggacgcucgccgucuuccugcugcucaucaugggccagcugaccuggaacgaccugauccggcucugcaucauggugggggccaacgcguccgaccgcaugggcaugggcaccaccuaccuggcccugauggccacguucaagaugcggccgauguucgccguggggcuccuguuccgccggcugaccagccgcgagguccuccugcugaccaucggccucucccugguggccagcgucgagcugcccaacucccucgaggagcugggggacggccuggcgaugggcaucaugaugcucaagcugcugaccgaguuccagccccaccagcucuggacgacccugcugagccucaccuucgugaagaccacgcugucccuggacuacgccuggaagaccaccgccauggugcucagcaucgucucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgugagcauccugcuguccagccuccugaagaacgacgucccccuggcgggcccgcucaucgccggcgggaugcugaucgccugcuacgugaucagcggcuccagcgccgaccugucccucgagaagacggccgaggugagcugggagcaggaggcggagcacuccggggccagccacaacauccuggucgaggugcaggacgacggcaccaugaagaucaaggacgaggagcgcgacgacacccugaccauccuccugaaggccacgcugcucgccguguccggggucuaccccaugagcauccccgccacccuguucgugugguacuucuggcagaagaagaagcagcgguccggcgugcugugggacacccccagcccgcccgaggucgagcgcgcggugcucgacgacggcaucuaccggauccugcagcgcgggcugcugggccggucccaggugggggucggcguguuccaggacgggguguuccacaccauguggcacgucacgcgcggcgccgugcucauguaccagggcaagcggcuggagcccagcugggccuccgugaagaaggaccugaucagcuacgggggcggguggcgcuuccagggcuccuggaacaccggggaggagguccaggugaucgccguggagcccggcaagaacccgaagaacguccagaccacccccggcacguucaagacccccgagggggaggugggcgccaucgcgcucgacuucaagcccgggaccagcggcuccccgaucgugaaccgggagggcaagaucgucgggcuguacggcaacgggguggugaccacgagcggcaccuacgucuccgccaucgcccaggccaaggccagccaggaggggccccugcccgagaucgaggacgagguguucaagaagcgcaaccucaccaucauggaccugcacccgggcagcggcaagacccggcgcuaccugcccgcgaucgugcgggaggccaucaagcgcaagcuccgcacgcugauccuggcccccacccgggucguggccuccgagauggcggaggcccucaaggggaugcccauccgcuaccagaccaccgccgucaagagcgagcacacgggccgggagaucgucgaccugaugugccacgccaccuucaccaugcgccugcucuccccggugcgggugcccaacuacaacaugaucaucauggacgaggcccacuucaccgaccccgcgagcaucgccgcccgcggguacaucuccacgcgggucggcaugggggaggccgccgcgaucuucaugaccgccacgccgcccggcagcguggaggccuucccccaguccaacgccgugauccaggacgaggagcgcgacauccccgagcggagcuggaacuccggcuacgacuggaucaccgacuuccccgggaagacggucugguucgugcccagcaucaaguccggcaacgacaucgccaacugccugcgcaagaacgggaagcgggugauccagcugagccgcaagaccuucgacaccgaguaccagaagaccaagaacaacgacugggacuacgucgugacgaccgacaucuccgagaugggcgcgaacuuccgggccgaccgcgugaucgacccccggcgcugccucaagcccgucauccugaaggacgggcccgagcgggugauccuggccggcccgaugcccgucaccguggccagcgcggcccagcgccggggccgcaucgggcgcaaccagaacaaggagggcgaccaguacguguacauggggcagccccucaacaacgacgaggaccacgcccacuggaccgaggccaagaugcugcuggacaacaucaacacgcccgagggcaucaucccggcccucuucgagcccgagcgggagaaguccgcggccaucgacggggaguaccgccugcggggcgaggcccgcaagaccuucgucgagcugaugcggcgcggcgaccuccccguguggcugagcuacaagguggccuccgagggguuccaguacagcgaccggcgcuggugcuucgacggcgagcggaacaaccagguccuggaggagaacauggacguggagaucuggaccaaggagggggagcgcaagaagcuccggccccgcuggcuggacgcccggaccuacuccgacccgcuggcgcuccgcgaguucaaggaguucgccgccggccggcgcagcgugagcggcgaccugauccuggagaucgggaagcucccccagcaccugacccugcgggcccagaacgcccucgacaaccuggucaugcugcacaacuccgagcagggcgggaaggcguaccgccacgccauggaggagcuccccgacacgaucgagacccugaugcugcucgcccugaucgccgugcugaccggcggggugacccucuucuuccugagcggcaagggccuggggaagacguccaucggccuccugugcgucaccgcgagcuccgcccugcucuggauggccagcguggagccccacuggaucgccgccuccaucauccuggaguucuuccugauggugcuccugaucccggagcccgaccggcagcgcacgccccaggacaaccagcuggcguacgucgugaucgggcuccuguucaugauccugaccguggccgccaacgagaugggccuccuggagacgaccaagaaggaccuggggaucggcuacgucgccgccgagaaccaccagcacgcgaccaugcucgacguggaccugcacccggccagcgccuggacccuguacgccguggccacgaccgucaucacccccaugaugcggcacaccaucgagaacacgaccgcgaacaucucccucaccgccaucgccaaccaggccgccauccugaugggccuggacaagggguggcccaucagcaagauggacaucggcgugccccuccuggcgcuggggugcuacucccaggugaacccgcucacccugacggccgccguccugaugcucguggcccacuacgcgaucaucggccccgggcugcaggccaaggccacccgcgaggcccagaagcgcaccgccgcgggcaucaugaagaaccccaccguggacggcaucgucgccaucgaccuggaccccgugguguacgacgccaaguucgagaagcagcucgggcagaucaugcugcugauccucugcacgagccagauccugcugaugcggaccaccugggcccucugcgaguccaucacccuggccacgggcccgcugaccacccucugggaggggagccccggcaaguucuggaacaccacgaucgcggucuccauggccaacaucuuccgcggcagcuaccuggccggggccggccuggccuucucccucaugaagucccucgggggcgggcggcgcgggaccggcgcgcagggggagacccugggcgagaaguggaagcggcagcucaaccagcuguccaagagcgaguucaacaccuacaagcgcagcgggaucauggagguggaccgguccgaggccaaggagggccugaagcgcggggagacgaccaagcacgccgugagccggggcaccgccaagcuccgcugguucgucgagcggaaccuggugaagcccgagggcaaggugaucgaccuggggugcggccgcgggggcugguccuacuacugcgcggggcugaagaaggucaccgaggugaagggcuacaccaagggcgggcccggccacgaggagccgauccccauggccacguacggguggaaccucgugaagcugcacagcggcaaggacgucuucuucaugccgcccgagaagugcgacacccugcucugcgacaucggggaguccagcccgaaccccaccaucgaggagggccggacccugcgcgugcugaagaugguggagcccuggcuccggggcaaccaguucugcaucaagauccugaaccccuacaugccguccgucguggagacgcuggagcagaugcagcgcaagcacgggggcaugcucgugcggaacccccugagccgcaacuccacccacgagauguacugggucagcugcgggaccggcaacaucguguccgccgugaacaugaccagccggaugcugcucaaccgcuucacgauggcccaccgcaagcccaccuacgagcgggacgucgaccugggcgccgggacccgccacguggcgguggagcccgaggucgccaaccuggacaucaucggccagcggaucgagaacaucaagaacgagcacaaguccaccuggcacuacgacgaggacaacccguacaagacgugggccuaccacgggagcuacgaggugaagcccuccggcagcgccuccagcauggucaacgggguggugcgccuccugaccaagcccugggacgucauccccauggugacccagaucgccaugaccgacacgaccccguucggccagcagcggguguucaaggagaaggucgacacccgcacgccccgggcgaagcgcggcacgacccagaucauggaggugaccgccaaguggcuguggggguuccucucccggaacaagaagccccgcaucugcacccgggaggaguucacgcgcaaggugcggagcaacgccgccaucggcgccgucuucguggacgagaaccaguggaacagcgcgaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcgggguggagggcgaggggcugcacaagcucggcuacauccugcgggacaucuccaagaucccgggcgggaacauguacgccgacgacaccgccggcugggacacccgcaucacggaggacgaccugcagaacgaggcgaagaucaccgacaucauggagcccgagcacgcccuccuggccaccagcaucuucaagcugaccuaccagaacaaggucgugcgcgugcagcggcccgccaagaacgggacggucauggacgugaucucccgccgggaccagcgcggcagcggccagguggggaccuacggccucaacaccuucaccaacauggagguccagcugauccggcagauggaguccgaggggaucuuccugcccagcgagcucgagacgccgaaccuggccgagcgcgcgcuggacuggcucgagaagcacggcgccgagcggcugaagcgcauggccaucuccggggacgacugcguggugaagcccaucgacgaccgguucgccaccgcccugaccgcgcucaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcuggugggccgggcccgcgugagccagggggccggcuggucccuccgggagaccgccugccugggcaagagcuacgcccagauguggcagcugauguacuuccaccgccgggaccuccgccuggcggccaacgccaucugcuccgccguccccguggacugggugcccaccagccggacgaccuggagcauccacgcgcaccaccaguggaugaccaccgaggacaugcuguccgucuggaaccgcguguggaucgaggagaacccguggauggaggacaagacgcacgugagcuccugggaggagguccccuaccucggcaagcgcgaggaccaguggugcggcagccugaucgggcugaccgcccgggccaccugggccaccaacauccagguggccaucaaccaggugcgccggcucaucggcaacgagaacuaccuggacuacaugacguccaugaagcgcuucaagaacgagagcgaccccgagggggcgcugugguga

SEQ ID NO: 8277 - RNA, 9879 nt, Artificial Sequence
  derived and/or modified CDS sequence (opt1) from DENV-1__GU131839__SS-prME
agcgugaccaugcugcucaugcugcugcccaccgcccucgccuuccaccugaccacccgcggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaccguccaguacgagaaccucaaguacuccgugaucgugaccguccacacgggcgaccagcaccagguggggaacgagaccaccgagcacggcaccaucgcgaccaucacgccccaggcccccaccagcgagauccagcugaccgacuacggggcccugacccucgacugcagcccccggacgggccuggacuucaacgagaugguccugcucaccaugaaggagaaguccuggcuggugcacaagcagugguuccuggaccucccgcugcccuggaccuccggggccagcaccagccaggagacguggaaccggcaggaccugcucgugaccuucaagaccgcccacgcgaagaagcaggaggucguggugcugggcucccaggagggcgccaugcacaccgcccugacgggggccaccgagauccagaccagcggcaccacgaccaucuucgccgggcaccucaagugccgccugaagauggacaagcugacccucaagggcauguccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccggcugaucaccgccaacccgaucgucaccgacaaggagaagcccgugaacaucgagaccgagccgcccuucggggagagcuacaucguggucggcgccggcgagaaggcgcucaagcuguccugguucaagcgcgggagcuccaucggcaagauguucgaggccacggcccgcggggcgcgccgcauggccauccugggcgacaccgcgugggacuucgggagcaucggcggcguguucaccuccguggggaagcucguccaccagguguucggcaccgccuacggggugcuguucagcggcgucuccuggacgaugaagaucgggaucggcauccugcucaccuggcugggccugaacagccgguccaccagccucuccaugaccugcaucgccguggggauggugacgcuguaccugggcgucauggugcaggccgacagcgggugcgugaucaacuggaagggccgcgagcucaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacccggcuggagaacaucauguggaagcagaucagcaacgagcucaaccacauccugcuggagaacgacaugaaguucacggucguggugggggacgccaacggcauccucguccaggggaagaagaugauccgcccccagcccauggagcacaaguacuccuggaaguccuggggcaaggcgaagaucaucggcgccgacacccagaacaccaccuucaucaucgacgggcccgacacgccggagugccccgacggccagcgggccuggaacaucugggagguggaggacuacggguucggcguguucaccaccaacaucuggcugaagcugcgcgacuccuacacccagaugugcgaccaccggcucaugagcgccgcgaucaaggacuccaaggccguccacgccgacaugggcuacuggaucgagagcgagaagaacgagacguggaagcuggcccgcgccuccuucaucgaggugaagaccugcaccuggcccaagagccacacccugugguccaacggggugcucgagagcgagaugaucauccccaagaucuacggcgggccgaucucccagcacaacuaccggcccggcuacuucacgcagaccgcggggcccuggcaccugggcaagcuggagcucgacuucgaccugugcgagggcaccaccgucgugguggacgagcacugcgggaaccgcggcccgagccugcggacgaccaccgucaccgggaagaucauccacgaguggugcugccgcuccugcacgcugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacccucgccguguuccugcugcucaucaugggccagcugaccuggaacgaccugauccggcucugcaucauggugggggccaacgccuccgaccgcaugggcaugggcacgaccuaccuggcgcugauggccaccuucaagaugcggccgauguucgccgucgggcuccuguuccgccggcugaccagccgcgaggugcuccugcugacgaucggccucucccuggucgccagcguggagcugcccaacucccucgaggagcugggggacggccuggccaugggcaucaugaugcucaagcugcugaccgaguuccagccccaccagcucuggaccacccugcugagccucacguucgugaagaccgcgcugucccuggacuacgccuggaagaccaccgccaugguccucagcaucgugucccuguucccccugugccucagcacgaccucccagaagaccaccuggcugccggugcugcucgggagcuucggcugcaagccccugaccauguuccugaucacggagaacaagaucugggggcggaaguccuggccccucaacgagggcaucauggccaucgggaucgucagcauccugcuguccagccuccugaagaacgacgugccccuggcgggcccgcucaucgccggcgggaugcugaucgccugcuacgugaucagcggcuccagcgccgaccugucccucgagaaggccgcggaggucagcugggagcaggaggccgagcacuccggggccagccacaacauccugguggaggugcaggacgacggcaccaugaagaucaaggacgaggagcgcgacgacacccugaccauccuccugaaggccacgcugcucgccgucuccgggguguaccccaugagcauccccgcgacccuguucgugugguacuucuggcagaagaagaagcagcgguccggcguccugugggacacccccagcccgcccgagguggagcgcgccgugcucgacaacggcaucuaccggauccugcagcgcgggcugcugggccggucccaggucggggugggcguguuccaggacggggucuuccacaccauguggcacgugacgcgcggcgccgugcucauguaccagggcaagcggcuggagcccagcugggccuccgucaagaaggaccugaucagcuacgggggcggguggcgcuuccagggcuccuggaacaccggggaggagguccaggugaucgccgucgagcccggcaagaacccgaagaacgugcagaccacccccggcacguucaagacccccgagggggaggugggcgcgaucgcccucgacuucaagcccgggaccagcggcuccccgaucgucaaccgggagggcaagaucguggggcuguacggcaacgggguggucaccacgagcggcaccuacguguccgccaucgcccaggccaaggcgagccaggaggggccccugcccgagaucgaggacgagguguucaagaagcgcaaccucaccaucauggaccugcacccgggcagcggcaagacccggcgcuaccugcccgccaucguccgggaggccaucaagcgcaagcuccgcacgcugauccuggcccccacccgggugguggcguccgagauggccgaggcccucaaggggaugcccauccgcuaccagaccaccgccgucaagagcgagcacacgggccgggagaucguggaccugaugugccacgccaccuucaccaugcgccugcucuccccggugcggguccccaacuacaacaugaucaucauggacgaggcgcacuucaccgaccccgccagcaucgccgcccgcggguacaucuccacgcgggugggcaugggggaggccgcggccaucuucaugaccgccacgccgcccggcagcguggaggccuucccccaguccaacgccgucauccaggacgaggagcgcgacauccccgagcggagcuggaacuccggcuacgacuggaucaccgacuuccccgggaagacggugugguucgugcccagcaucaaguccggcaacgacaucgcgaacugccugcgcaagaacgggaagcgggucauccagcugagccgcaagaccuucgacaccgaguaccagaagaccaagaacaacgacugggacuacguggugacgaccgacaucuccgagaugggcgccaacuuccgggccgaccgcgucaucgacccccggcgcugccucaagcccgugauccugaaggacgggcccgagcgggucauccuggccggcccgaugcccgugaccguggcgagcgccgcccagcgccggggccgcaucgggcgcaaccagaacaaggagggcgaccaguacgucuacauggggcagccccucaacaacgacgaggaccacgcccacuggaccgaggccaagaugcugcuggacaacaucaacacgcccgagggcaucaucccggcccucuucgagcccgagcgggagaaguccgccgccaucgacggggaguaccgccugcggggcgaggcccgcaagaccuucguggagcugaugcggcgcggcgaccuccccguguggcugagcuacaaggucgccuccgagggguuccaguacagcgaccggcgcuggugcuucgacggcgagcggaacaaccaggugcuggaggagaacauggacguggagaucuggaccaaggagggggagcgcaagaagcuccggccccgcuggcuggacgcgcggaccuacuccgacccgcuggcccuccgcgaguucaaggaguucgccgccggccggcgcagcgucagcggcgaccugauccuggagaucgggaagcucccccagcaccugacccugcgggcccagaacgcgcucgacaaccuggugaugcugcacaacuccgagcagggcgggaaggccuaccgccacgccauggaggagcuccccgacacgaucgagacccugaugcugcucgcccugaucgcggugcugaccggcggggucacccucuucuuccugagcggcaagggccuggggaagacguccaucggccuccugugcgugaccgccagcuccgcccugcucuggauggccagcguggagccccacuggaucgccgcguccaucauccuggaguucuuccugaugguccuccugaucccggagcccgaccggcagcgcacgccccaggacaaccagcuggccuacguggugaucgggcuccuguucaugauccugaccgucgccgccaacgagaugggccuccuggagacgaccaagaaggaccuggggaucggcuacguggccgcggagaaccaccagcacgccaccaugcucgacguggaccugcacccggccagcgccuggacccuguacgccgucgcgacgaccgugaucacccccaugaugcggcacaccaucgagaacacgaccgccaacaucucccucaccgccaucgccaaccaggccgcgauccugaugggccuggacaagggguggcccaucagcaagauggacaucggcgugccccuccuggcccuggggugcuacucccaggucaacccgcucacccugacgagcgccgugcugaugcucguggcccacuacgcgaucaucggccccgggcugcaggccaaggccacccgcgaggcccagaagcgcaccgccgcgggcaucaugaagaaccccaccgucgacggcaucguggccaucgaccuggaccccguggucuacgacgccaaguucgagaagcagcucgggcagaucaugcugcugauccucugcacgucccagauccugcugaugcggaccaccugggcccucugcgagagcaucacccuggccacgggcccgcugaccacccucugggaggggucccccggcaaguucuggaacaccacgaucgcggugagcauggccaacaucuuccgcggcuccuaccuggccggggccggccuggccuucagccucaugaagucccucgggggcgggcggcgcggcaccggcgcgcagggggagacccugggcgagaaguggaagcggcagcucaaccagcugagcaagagcgaguucaacaccuacaagcgcuccgggaucauggagguggaccggagcgaggccaaggagggccugaagcgcggggagacgaccaagcacgccgucucccggggcaccgccaagcuccgcugguucguggagcggaaccuggugaagcccgagggcaaggucaucgaccuggggugcggccgcgggggcuggagcuacuacugcgcggggcugaagaaggugaccgaggugaagggcuacaccaagggcgggcccggccacgaggagccgauccccauggccacguacggguggaaccucgucaagcugcacuccggcaaggacguguucuucaugccgcccgagaagugcgacacccugcucugcgacaucggggagagcuccccgaaccccaccaucgaggagggccggacccugcgcgugcugaagauggucgagcccuggcuccggggcaaccaguucugcaucaagauccugaaccccuacaugccgagcgugguggagacgcuggagcagaugcagcgcaagcacgggggcaugcucguccggaacccccugucccgcaacagcacccacgagauguacuggguguccugcgggaccggcaacaucgugagcgccgucaacaugaccucccggaugcugcucaaccgcuucacgauggcccaccgcaagcccaccuacgagcgggacguggaccugggcgccgggacccgccacguggcggucgagcccgagguggccaaccuggacaucaucggccagcggaucgagaacaucaagaacgagcacaagagcaccuggcacuacgacgaggacaacccguacaagacgugggccuaccacggguccuacgaggucaagcccagcggcuccgccagcuccauggugaacggggugguccgccuccugaccaagcccugggacgugauccccauggugacccagaucgccaugaccgacacgaccccguucggccagcagcgggucuuccgcgagaagguggacacccggacgccccgcgcgaagcggggcacgacccagaucauggaggugaccgccaaguggcuguggggguuccucagccgcaacaagaagccccggaucugcacccgcgaggaguucacgcggaagguccgcagcaacgccgccaucggcgccguguucguggacgagaaccaguggaacuccgcgaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaagggcagccgggcgaucugguacauguggcugggggcccgcuuccuggaguucgaggcccucggcuucaugaacgaggaccacugguucucccgggagaacagccuguccggggucgagggcgaggggcugcacaagcucggcuacauccugcgcgacaucagcaagaucccgggcgggaacguguacgccgacgacaccgccggcugggacacccgcaucacggaggacgaccugcagaacgaggcgaagaucaccgacaucauggagcccgagcacgcccuccuggccaccuccaucuucaagcugaccuaccagaacaaggugguccgggugcagcgccccgccaagaacgggacggugauggacgucaucagccggcgcgaccagcggggcuccggccagguggggaccuacggccucaacaccuucaccaacauggaggugcagcugauccgccagauggagagcgaggggaucuuccugcccuccgagcucgagacgccgaaccuggccgagcgggcgcuggacuggcucgagaagcacggcgucgagcgccugaagcggauggccaucagcggggacgacugcguggugaagcccaucgacgaccgcuucgccaccgcccugaccgcccucaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcuggugggccgcgcgcgggugucccagggggccggcuggagccuccgcgagaccgccugccuggggaaguccuacgcccagauguggcagcugauguacuuccaccggcgcgaccuccggcuggccgcgaacgccaucugcagcgccguccccguggacugggugcccaccagccgcacgaccugguccauccacgcccaccaccaguggaugaccaccgaggacaugcugagcgucuggaaccgcguguggaucgaggagaacccguggauggaggacaagacgcacguguccagcugggaggagguccccuaccucggcaagcgggaggaccaguggugcggcucccugaucgggcugaccgcgcgcgccaccugggccaccaacauccagguggccaucaaccaggugcggcgccucaucggcaacgagaacuaccuggacuacaugacgagcaugaagcgguucaagaacgaguccgacagcgagggggcccugugguga

SEQ ID NO: 8278 - RNA, 9879 nt, Artificial Sequence
  derived and/or modified CDS sequence (opt1) from DENV-1__GU131841__SS-prME
agcgugaccaugcugcucaugcugcugcccaccgcccucgccuuccaccugaccacccgcggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgagaagcgguccguggcccuggcgccccacgucggccuggggcucgagacccgcaccgagaccuggaugagcuccgagggcgccuggaagcagauccagcggguggagaccugggcccugcgccaccccggguucacggugaucgccuucuuccuggccuacgcgaucggcaccagcaucacccagaaggggaucaucuucauccuccugaugcuggugacccccuccauggccaugcggugcgugggcaucggcaaccgcgacuucguggaggggcucagcggcgccacgugggucgacguggugcuggagcacggguccugcgucaccaccauggccaagaacaagcccacccuggacaucgagcuccugaagacggaggugaccaaccccgccgugcugcggaagcucugcaucgaggcgaagaucagcaacaccaccacggacucccgcugcccgacccagggcgaggccacccuggucgaggagcaggacgccaacuucgugugccggcgcaccuucguggaccggggcugggggaacggcugcgggcuguucggcaaggggagccuccugacgugcgccaaguucaagugcgucaccaagcuggagggcaagaucgugcaguacgagaaccucaaguacuccgugaucgucaccgugcacaccggcgaccagcaccaggucgggaacgagacgaccgagcacggcaccaucgccaccaucacgccccaggcgcccacgagcgagauccagcugaccgacuacggggcccugacccucgacugcagcccccggaccggccuggacuucaacgagauggugcugcucacgaugaaggagaaguccuggcuggugcacaagcagugguuccuggaccucccgcugcccuggaccuccggggccagcaccagccaggagaccuggaaccggcaggaccugcucgucacguucaagaccgcccacgccaagaagcaggagguggugguccugggcucccaggagggcgcgaugcacaccgcccugaccggggccacggagauccagaccagcggcaccaccacgaucuucgccgggcaccucaagugccgccugaagauggacaagcugacccucaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcugaucacggccaacccgaucgugaccgacaaggagaagcccgugaacaucgagaccgagccgcccuucggggagagcuacaucgucgugggcgccggcgagaaggcccucaagcuguccugguucaagcgcgggagcuccaucggcaagauguucgaggcgaccgcccgcggggcccgccgcauggccauccugggcgacacggccugggacuucgggagcaucggcggcguguucaccuccgucgggaagcucgugcaccagguguucggcaccgcguacgggguccuguucagcggcguguccuggaccaugaagaucgggaucggcauccugcucacguggcugggccugaacagccgguccaccagccucuccaugaccugcaucgccguggggauggucacccuguaccugggcgugauggugcaggccgacagcgggugcgucaucaacuggaagggccgcgagcucaagugcggguccggcaucuucgugacgaacgaggugcacaccuggaccgagcaguacaaguuccaggccgacagcccgaagcggcugagcgccgcgaucggcaaggccugggaggagggggucugcggcauccgcuccgccacccggcuggagaacaucauguggaagcagaucagcaacgagcucaaccacauccugcuggagaacgacaugaaguucaccgugguggucggggacgccaacggcauccucgcccaggggaagaagaugauccgcccccagcccauggagcacaaguacuccuggaaguccuggggcaaggcgaagaucaucggcgccgacauccagaacacgaccuucaucaucgacgggcccgacaccccggagugccccgacggccagcgggccuggaacaucugggagguggaggacuacggguucggcguguucaccacgaacaucuggcugaagcugcgcgacuccuacacccagaugugcgaccaccggcucaugagcgccgcgaucaaggacuccaaggccguccacgccgacaugggcuacuggaucgagagcgagaagaacgagaccuggaagcuggcccgcgccuccuucaucgaggugaagaccugcacguggcccaagagccacacccugugguccaacggggugcucgagagcgagaugaucauccccaagaucuacggcgggccgaucucccagcacaacuaccggcccggcuacuucacccagaccgcggggcccuggcaccugggcaagcuggagcucgacuucgaccugugcgagggcacgaccgucgugguggacgagcacugcgggaaccgcggcccgagccugcggaccaccacggucaccgggaagaucauccacgaguggugcugccgcuccugcacccugccgccccugcgguuccgcggcgaggacgggugcugguacggcauggagauccggcccgugaaggagaaggaggagaaccuggugcgcagcauggucuccgccggcagcggggagguggacagcuucucccucggcauccugugcgugagcaucaugaucgaggaggucaugcggucccgcuggagccgcaagaugcugaugaccgggacgcucgccguguuccugcugcucaucaugggccagcugaccuggaacgaccugauccggcucugcaucauggugggggccaacgccuccgaccgcaugggcaugggcaccaccuaccuggcgcugauggccacguucaagaugcggccgauguucgccgucgggcuccuguuccgccggcugaccagccgcgaggugcuccugcugaccaucggccucucccuggucgccagcguggagcugcccaacucccucgaggagcugggggacggccuggccaugggcaucaugaugcucaagcugcugaccgaguuccagccccaccagcucuggacgacccugcugagccucaccuucgugaagaccacgcugucccuggacuacgcguggaagaccaccgccaugguccucagcaucgugucccuguucccccugugccucagcaccacgucccagaagaccaccuggcugccggugcugcucgggagcuucggcugcaagccccugaccauguuccugaucaccgagaacaagaucugggggcggaaguccuggccccucaacgagggcaucauggccaucgggaucgucagcauccugcuguccagccuccugaagaacgacgugccccuggccggcccgcucaucgcgggcgggaugcugaucgccugcuacgugaucagcggcuccagcgccgaccugucccucgagaaggccgccgaggucagcugggagcaggaggcggagcacuccggggccagccacaacauccugguggaggugcaggacgacggcacgaugaagaucaaggacgaggagcgcgacgacacccugaccauccuccugaaggccacccugcucgccgucuccgggguguaccccaugagcauccccgccacgcuguucgugugguacuucuggcagaagaagaagcagcgguccggcguccugugggacacccccagcccgcccgagguggagcgcgcggugcucgacgacggcaucuaccggauccugcagcgcgggcugcugggccggucccaggucggggugggcguguuccaggacggggucuuccacaccauguggcacgugacccgcggcgccgugcucauguaccagggcaagcggcuggagcccagcugggccuccgucaagaaggaccugaucagcuacgggggcggguggcgcuuccagggcuccuggaacacgggggaggagguccaggugaucgccgucgagcccggcaagaacccgaagaacgugcagaccacccccggcaccuucaagacgcccgagggggaggugggcgccaucgcgcucgacuucaagcccgggaccagcggcuccccgaucgucaaccgggagggcaagaucguggggcuguacggcaacgggguggucaccaccagcggcacguacguguccgccaucgcccaggccaaggccagccaggaggggccccugcccgagaucgaggacgagguguucaagaagcgcaaccucaccaucauggaccugcacccgggcagcggcaagacccggcgcuaccugcccgcgaucguccgggaggccaucaagcgcaagcuccgcacccugauccuggcccccacgcgggugguggccuccgagauggcggaggcccucaaggggaugcccauccgcuaccagaccaccgccgucaagagcgagcacaccggccgggagaucguggaccugaugugccacgccacguucaccaugcgccugcucuccccggugcggguccccaacuacaacaugaucaucauggacgaggcccacuucaccgaccccgcgagcaucgccgcccgcggguacaucuccacccgggugggcaugggggaggccgccgcgaucuucaugacggccacgccgcccggcagcguggaggccuucccccaguccaacgccgucauccaggacgaggagcgcgacauccccgagcggagcuggaacuccggcuacgacuggaucaccgacuuccccgggaagaccgugugguucgugcccagcaucaaguccggcaacgacaucgccaacugccugcgcaagaacgggaagcgggucauccagcugagccgcaagacguucgacaccgaguaccagaagaccaagaacaacgacugggacuacguggugaccacggacaucuccgagaugggcgcgaacuuccgggccgaccgcgucaucgacccccggcgcugccucaagcccgugauccugaaggacgggcccgagcgggucauccuggccggcccgaugcccgugaccguggccagcgcggcccagcgccggggccgcaucgggcgcaaccagaacaaggagggcgaccaguacgucuacauggggcagccccucaacaacgacgaggaccacgcccacuggaccgaggccaagaugcugcuggacaacaucaacacccccgagggcaucaucccggcccucuucgagcccgagcgggagaaguccgcggccaucgacggggaguaccgccugcggggcgaggcccgcaagacguucguggagcugaugcggcgcggcgaccuccccguguggcugagcuacaaggucgccuccgagggguuccaguacagcgaccggcgcuggugcuucgacggcgagcggaacaaccaggugcuggaggagaacauggacguggagaucuggaccaaggagggggagcgcaagaagcuccggccccgcuggcuggacgcccggaccuacuccgacccgcuggcgcuccgcgaguucaaggaguucgccgccggccggcgcagcgucagcggcgaccugauccuggagaucgggaagcucccccagcaccugacccugcgggcccagaacgcccucgacaaccuggugaugcugcacaacuccgagcagggcgggaaggcguaccgccacgccauggaggagcuccccgacaccaucgagacgcugaugcugcucgcccugaucgccgugcugaccggcggggucacccucuucuuccugagcggcaagggccuggggaagaccuccaucggccuccugugcgugacggcgagcuccgcccugcucuggauggccagcguggagccccacuggaucgccgccuccaucauccuggaguucuuccugaugguccuccugaucccggagcccgaccggcagcgcacgccccaggacaaccagcuggcguacguggugaucgggcuccuguucaugauccugaccgucgccgccaacgagaugggccuccuggagaccacgaagaaggaccuggggaucggcuacguggccgccgagaaccaccagcacgcgaccaugcucgacguggaccugcacccggccagcgccuggacccuguacgccgucgccaccacggugaucacccccaugaugcggcacaccaucgagaacaccacggcgaacaucucccucaccgccaucgccaaccaggccgccauccugaugggccuggacaagggguggcccaucagcaagauggacaucggcgugccccuccuggcgcuggggugcuacucccaggucaacccgcucacccugaccgccgccgugcugaugcucguggcccacuacgcgaucaucggccccgggcugcaggccaaggccacgcgcgaggcccagaagcgcaccgccgcgggcaucaugaagaaccccaccgucgacggcaucguggccaucgaccuggaccccguggucuacgacgccaaguucgagaagcagcucgggcagaucaugcugcugauccucugcaccagccagauccugcugaugcggacgaccugggcccucugcgaguccaucacccuggccaccggcccgcugacgacccucugggaggggagccccggcaaguucuggaacaccaccaucgcgguguccauggccaacaucuuccgcggcagcuaccuggccggggccggccuggccuucucccucaugaagucccucgggggcgggcggcgcgggacgggcgcgcagggggagacccugggcgagaaguggaagcggcagcucaaccagcuguccaagagcgaguucaacaccuacaagcgcagcgggaucauggagguggaccgguccgaggccaaggagggccugaagcgcggggagaccacgaagcacgccgucagccggggcaccgccaagcuccgcugguucguggagcggaaccuggugaagcccgagggcaaggucaucgaccuggggugcggccgcgggggcugguccuacuacugcgcggggcugaagaaggugaccgaggugaagggcuacaccaagggcgggcccggccacgaggagccgauccccauggccaccuacggguggaaccucgucaagcugcacagcggcaaggacguguucuucaugccgcccgagaagugcgacacgcugcucugcgacaucggggaguccagcccgaaccccaccaucgaggagggccggacccugcgcgugcugaagauggucgagcccuggcuccggggcaaccaguucugcaucaagauccugaaccccuacaugccguccgugguggagacccuggagcagaugcagcgcaagcacgggggcaugcucguccggaacccccugagccgcaacuccacgcacgagauguacugggugagcugcgggaccggcaacaucguguccgccgucaacaugaccagccggaugcugcucaaccgcuucaccauggcccaccgcaagcccacguacgagcgggacguggaccugggcgccgggacccgccacguggcggucgagcccgagguggccaaccuggacaucaucggccagcggaucgagaacaucaagaacgagcacaaguccaccuggcacuacgacgaggacaacccguacaagaccugggccuaccacgggagcuacgaggucaagcccuccggcagcgccuccagcauggugaacggggugguccgccuccugacgaagcccugggacgugauccccauggugacccagaucgccaugaccgacaccacgccguucggccagcagcgggucuucaaggagaagguggacacccgcacgccccgggcgaagcgcggcaccacgcagaucauggaggugaccgccaaguggcuguggggguuccucucccggaacaagaagccccgcaucugcacccgggaggaguucacccgcaagguccggagcaacgccgccaucggcgccguguucguggacgagaaccaguggaacagcgcgaaggaggccgucgaggacgagcgcuucugggaccuggugcaccgggagcgcgagcugcacaagcaggggaagugcgccacgugcguguacaacaugaugggcaagcgggagaagaagcucggggaguucggcaaggccaagggcucccgcgcgaucugguacauguggcugggggcccgguuccuggaguucgaggcccucggcuucaugaacgaggaccacugguucagccgcgagaacucccugagcggggucgagggcgaggggcugcacaagcucggcuacauccugcgggacaucuccaagaucccgggcgggaacauguacgccgacgacaccgccggcugggacacccgcaucaccgaggacgaccugcagaacgaggcgaagaucacggacaucauggagcccgagcacgcccuccuggccaccagcaucuucaagcugaccuaccagaacaagguggugcgcguccagcggcccgccaagaacgggaccgugauggacgugaucucccgccgggaccagcgcggcagcggccaggucgggacguacggccucaacaccuucaccaacauggaggugcagcugauccggcagauggaguccgaggggaucuuccugcccagcgagcucgagaccccgaaccuggccgagcgcgcgcuggacuggcucgagaagcacggcgccgagcggcugaagcgcauggccaucuccggggacgacugcguggucaagcccaucgacgaccgguucgccacggcccugaccgcgcucaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcuggugggccgggcccgcgucagccagggggccggcuggucccuccgggagaccgccugccugggcaagagcuacgcccagauguggcagcugauguacuuccaccgccgggaccuccgccuggcggccaacgccaucugcuccgccgugcccguggacuggguccccaccagccggaccacguggagcauccacgcgcaccaccaguggaugaccaccgaggacaugcuguccguguggaaccgcguguggaucgaggagaacccguggauggaggacaagacccacgucagcuccugggaggaggugcccuaccucggcaagcgcgaggaccaguggugcggcagccugaucgggcugacggcccgggccaccugggccaccaacauccagguggccaucaaccagguccgccggcucaucggcaacgagaacuaccuggacuacaugaccuccaugaagcgcuucaagaacgagagcgaccccgagggggcgcugugguga

SEQ ID NO: 8279 - RNA, 9879 nt, Artificial Sequence
  derived and/or modified CDS sequence (opt1) from DENV-1__GQ868601__SS-prME
agcgugaccaugcugcucaugcugcugcccaccgcccucgccuuccaccugaccacccggggcggggagccccacaugaucgugagcaagcaggagcggggcaagagccuccucuucaagaccuccgugggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucacccggcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccggcugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccggcgcauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgggagcucaagugcgggagcggcaucuucgugacgaacgagguccacaccuggaccgagcaguacaaguuccaggccgacuccccgaagcgccugagcgccgcgaucggcaaggccugggaggagggggugugcggcauccggagcgccacccgccuggagaacaucauguggaagcagaucuccaacgagcucaacuacauccugcuggagaacgacaugaaguucaccguggucgugggggacgccaacggcauccucgcccaggggaagaagaugauccggccccagcccauggagcacaaguacagcuggaaguccuggggcaaggcgaagaucaucggcgccgacauccagaacacgaccuucaucaucgacgggcccgacaccccggagugccccgacgaccagcgcgccuggaacaucugggagguggaggacuacggcuucgggaucuucaccacgaacaucuggcugaagcugcgggacagcuacacccagaugugcgaccaccgccucauguccgccgcgaucaaggacagcaaggccguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagaugaucauccccaagaucuacgggggcccgaucagccagcacaacuaccgccccggguacuucacccagaccgcgggccccuggcaccuggggaagcuggagcucgacuucgaccugugcgagggcaccacggucgugguggacgagcacugcggcuaccgggggccgucccugcgcaccaccaccgucacgggcaagaucauccacgaguggugcugccggagcugcacccugccgccccugcgcuuccgcggggaggacggcugcugguacgggauggagauccgccccgugaaggagaaggaggagaaccuggugcgguccauggucagcgccggcuccggcgagguggacagcuucagccucgggauccugugcguguccauccugaucgaggaggucaugcgcagccgguggucccgccgcaugcucaugaccggcacccuggccguguuccugcuccugaucauggggcagcugacguggaacgaccucauccggcugugcaucauggugggcgccaacgccagcgaccgcauggggaugggcaccaccuaccuggcgcucauggccaccuucaagaugcggccgauguucgccgucggccugcuguuccgccggcucacgucccgcgaggugcugcugcucaccaucgggcugagccugguggccuccgucgagcuccccaacagccuggaggagcugggcgacgggcucgccaugggcaucaugaugcugaagcugcucaccgacuuccagccccaccagcuguggaccacgcugcucucccugaccuucauccggaccacccugagccucgacuacgcguggaagacgauggccauggcccuguccaucgugagccuguucccccucugccuguccaccaccagccagaagaccacguggcugccgguccuccugggcuccuucgggugcaagccccugaccauguuccucaucaccgagaacaagaucuggggccgcaagagcuggcccaucaacgaggggaucauggccgugggcaucguguccauccugcugagcucccuccugaagaacgacgucccccuggcggggccgcucaucgccggcggcaugcugaucgccugcuacgugaucagcgggagcuccgccgaccugagccucgagaaggccgcggagguguccugggaggaggaggccgagcacagcggcaccucccacaacauccuggucgaggugcaggacgacgggaccaugaagaucaaggacgaggagcgggacgacacgcugaccauccuccugaaggccacccugcucgccgugagcggcgucuaccccauguccauccccgccacccuguucgugugguacuucuggcagaagaagaagcagcgcagcggggugcugugggacacgcccuccccgcccgaggucgagcgggcggugcuggacgacggcaucuaccgcauccuccagcggggccugcuggggcgcagccaggugggcgucgggguguuccaggacggcguguuccacaccauguggcacgucacccgcggggccgugcucauguaccagggcaagcgccuggagcccuccugggccagcgugaagaaggaccugaucuccuacggcgggggcuggcgguuccaggggagcuggaacaccggcgaggagguccaggugaucgccguggagcccgggaagaacccgaagaacguccagacgacccccggcaccuucaagacccccgagggcgaggugggggccaucgcgcucgacuucaagcccggcacguccgggagcccgaucgugaaccgcgagggcaagaucgucggccuguacgggaacggcguggugaccaccuccgggaccuacgucagcgccaucgcccaggccaaggccucccaggagggcccccugcccgagaucgaggacgagguguucaagaagcggaaccucacgaucauggaccugcacccggggagcggcaagacccgccgguaccugcccgcgaucgugcgcgaggccaucaagcgcaagcuccggacccugauccuggcccccacccgcgucguggccagcgagauggcggaggcccucaagggcaugcccauccgguaccagacgaccgccgugaaguccgagcacaccgggcgcgagaucgucgaccugaugugccacgccaccuucacgaugcggcugcucagcccggugcgcgugcccaacuacaacaugaucaucauggacgaggcccacuucaccgaccccgcguccaucgccgcccggggcuacaucagcacccgcgucgggaugggcgaggccgccgcgaucuucaugaccgccacgcccccgggguccguggaggccuucccccagagcaacgccgugauccaggacgaggagcgggacauccccgagcgcuccuggaacagcggcuacgacuggaucaccgacuuccccggcaagaccgucugguucgugccguccaucaagagcgggaacgacaucgccaacugccugcggaagaacggcaagcgcgugauccagcugucccggaagaccuucgacacggaguaccagaagaccaagaacaacgacugggacuacgucgugaccaccgacaucagcgagaugggggcgaacuuccgcgccgaccgggugaucgacccccgccggugccucaagcccgucauccugaaggacggccccgagcgcgugauccuggccgggccgaugcccgugacggucgccuccgcggcccagcggcgcggccgcaucggccggaaccagaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugcgcggggaggcccggaagaccuucguggagcugaugcgccggggcgaccuccccgucuggcuguccuacaagguggccagcgagggcuuccaguacuccgaccgccgguggugcuucgacggggagcgcaacaaccaggugcuggaggagaacauggacgucgagaucuggacgaaggagggcgagcggaagaagcuccgcccccgguggcuggacgcccgcaccuacagcgacccgcuggcgcuccgggaguucaaggaguucgccgccgggcgccgguccgugagcggcgaccugauccuggagaucggcaagcucccccagcaccugacccugcgcgcccagaacgcccucgacaaccuggugaugcugcacaacagcgagcagggcgggaaggcguaccggcacgccauggaggagcuccccgacaccaucgagacccugaugcugcucgcccugaucgccguccugaccggcggggugacccucuucuuccuguccgggaaggggcugggcaagaccagcaucgggcuccugugcgugauggcguccagcgcccugcucuggauggccuccgucgagccccacuggaucgccgccagcaucauccuggaguucuuccugauggugcuccugaucccggagcccgaccgccagcggacgccccaggacaaccagcuggcguacguggucaucggccuccuguucaugauccugacgguggccgccaacgagauggggcuccuggagaccaccaagaaggaccugggcaucgggcacguggccgccgagaaccaccaccacgcgaccaugcucgacgucgaccugcgcccggccuccgccuggacgcuguacgccguggccaccaccgugaucacccccaugaugcgccacacgaucgagaacaccaccgcgaacaucagccucaccgccaucgccaaccaggccgccauccugaugggccuggacaagggcuggcccaucuccaagauggacaucggggucccccuccuggcgcugggcugcuacagccaggugaacccgcucacgcugaccgccgccgugcugaugcucgucgcccacuacgcgaucaucgggcccggccugcaggccaaggccacccgggaggcccagaagcgcaccgccgcggggaucaugaagaaccccacgguggacggcaucgugaccaucgaccuggaccccgucguguacgacgccaaguucgagaagcagcucggccagaucaugcugcugauccucugcaccucccagauccugcugaugcggaccacgugggcccucugcgagagcaucacccuggccaccgggccgcugaccacgcucugggagggcucccccgggaaguucuggaacaccaccaucgccgugagcauggcgaacaucuuccgcggcuccuaccuggccggcgccgggcuggccuucagccucaugaagucccugggcgggggccggcgcgggaccggcgcccagggcgagacgcugggggagaaguggaagcggcagcucaaccagcugagcaaguccgaguucaacaccuacaagcgcagcggcaucauggaggucgaccggagcgaggcgaaggaggggcugaagcgcggcgagaccaccaagcacgccgugucccgggggacggccaagcugcgcugguucguggagcggaaccucgucaagcccgagggcaaggugaucgaccugggcugcgggcgcggcggguggagcuacuacugcgccggccugaagaaggugaccgaggucaagggguacaccaagggcggccccgggcacgaggagccgauccccauggcgaccuacggcuggaaccucgugaagcugcacuccgggaaggacguguucuucacgccgcccgagaagugcgacacgcugcucugcgacaucggcgagagcuccccgaaccccaccaucgaggaggggcggacccugcgcguccugaagaugguggagcccuggcuccggggcaaccaguucugcaucaagauccugaaccccuacaugccgagcguggucgagacccuggagcagaugcagcgcaagcacggcgggaugcucgugcggaacccccugucccgcaacagcacgcacgagauguacuggguguccugcggcaccgggaacaucgucagcgccgugaacaugaccucccgcaugcugcucaaccgguucaccauggcccaccgcaagcccacguacgagcgggacguggaccugggcgccggcacccgccacgucgccguggagcccgagguggcgaaccuggacaucaucgggcagcggaucgagaacaucaagaacgagcacaagagcaccuggcacuacgacgaggacaacccguacaagaccugggccuaccacggcuccuacgaggucaagcccagcggguccgccagcuccauggugaacggcgugguccgccuccugacgaagcccugggacgugauccccauggucacccagaucgccaugaccgacaccacgccguucgggcagcagcggguguucaaggagaagguggacacccgcacgccccgggccaagcgcggcaccgcgcagaucauggaggucacggccaaguggcuguggggcuuccucagccggaacaagaagccccgcaucugcacccgggaggaguucacccgcaaggugcgguccaacgccgccaucggggccguguucgucgacgagaaccaguggaacagcgcgaaggaggccguggaggacgagcgcuucugggaccuggugcaccgggagcgcgagcugcacaagcagggcaagugcgcgaccugcgucuacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcguggagggggagggccugcacaagcucggguacauccugcgcgacaucagcaagaucccgggcggcaacauguacgccgacgacacggccgggugggacacccggaucaccgaggacgaccugcagaacgaggcgaagaucaccgacaucauggagcccgagcacgcccuccuggccacguccaucuucaagcugaccuaccagaacaaggugguccgcgugcagcggcccgccaagagcggcaccgugauggacgucaucucccgccgggaccagcgcgggagcggccaggugggcaccuacgggcucaacacguucaccaacauggaggugcagcugauccggcagauggaguccgagggcaucuucagccccuccgagcuggagaccccgaaccucgccaagcgcguccuggacuggcuggagaagcagggggcggagcggcucaagcgcauggccaucagcggcgacgacugcguggugaagcccaucgacgaccgguucgccaccgcccugacggcccugaacgacauggggaagguccgcaaggacaucccccagugggagcccuccaagggcuggaacgacuggcagcaggucccguucugcagccaccacuuccaccagcucaucaugaaggacggccgggagaucgugguccccugccgcaaccaggacgagcugguggggcgggcgcgcgugucccagggcgccggguggagccugcgggagaccgccugccucggcaaguccuacgcccagauguggcagcugauguacuuccaccgccgggaccugcgccucgccgcgaacgccaucugcagcgccguccccguggacugggugcccaccagccgcaccaccugguccauccacgcccaccaccaguggaugacgaccgaggacaugcugagcgucuggaaccggguguggaucgaggagaacccguggauggaggacaagacccacguguccagcugggaggagguccccuaccuggggaagcgcgaggaccaguggugcggcucccucaucggccugaccgcgcgggccacgugggccaccaacauccagguggccaucaaccaggugcgccggcugaucgggaacgagaacuaccucgacuacaugaccagcaugaagcgcuucaagaacgaguccgaccccgagggcgcccugugguga

SEQ ID NO: 8280 - RNA, 9879 nt, Artificial Sequence
  derived and/or modified CDS sequence (opt1) from DENV-1__EU660390__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaagcucaccgugaucgugggggacgucgcgggcauccuggggcagggccggaagaugauccgcccccagcccauggaguacaaguacagcuggaaguccuggggcaaggccaagaucaucggggccgacgcccagaacacgaccuucaucaucgacggccccaacaccccggagugccccgacgaccagcgggcguggaacaucugggagguggaggacuacggguucggcaucuucaccacgaacaucuggcugaagcuccgcgacagcuacacccaggugugcgaccaccggcugauguccgccgccaucaaggacagcaaggccguccacgccgacaugggcuacuggaucgaguccgagaagaacgagaccuggaagcuggcgcgcgccagcuucaucgaggugaagaccugcaucuggcccaagucccacacgcucuggagcaacggggugcuggaguccgagaugaucauccccaagaucuacggcgggccgaucagccagcacaacuaccggcccggcuacuucacccagaccgccgggcccuggcaccugggcaagcucgagcuggacuucgaccugugcgagggcaccacggucgugguggacgagcacugcgggaaccgcggcccgucccuccggaccaccaccgucacggggaagaucauccacgaguggugcugccgcagcugcacccugccgccccugcgguuccgcggcgaggacgggugcugguacggcauggagauccggcccgugaaggagaaggaggagaaccucgugaaguccauggucagcgccggcagcggggagguggacuccuucagccugggccugcucugcaucuccaucaugaucgaggaggugaugcgcagccgguggucccgcaagaugcugaugaccgggacccuggccgucuucuuccuccugaucaugggccagcugacguggaacgaccucauccgccugugcaucauggugggggcgaacgccagcgaccggaugggcaugggcaccaccuaccuggcccucauggccaccuucaagaugcgcccgauguucgccguggggcugcuguuccggcgccucacgucccgggagguccugcugcucaccaucggccugagccugguggcguccguggagcuccccaacagccuggaggagcugggggacggccucgccaugggcaucaugauccugaagcugcucaccgacuuccagucccaccagcugugggccacccugcucagccugacguucaucaagaccaccuucucccugcacuacgccuggaagaccauggcgaugguccucagcaucgugucccuguucccccugugccucagcacgaccucccagaagaccaccuggcugcccguccugcucgggagccugggcugcaagccgcugacgauguuccucaucgccgagaacaagaucugggggcgcaaguccuggccccugaacgagggcaucauggccguggggaucgugagcauccugcucagcucccugcugaagaacgacgucccccucgccggcccccugguggccggcgggaugcugaucgcgugcuacgugaucagcggcuccagcgccgaccucucccuggagaaggccgccgaggucagcugggaggaggaggccgagcacuccggggcgagccacaacauccugguggaggugcaggacgacggcaccaugaagaucaaggacgaggagcgggacgacacccucaccauccugcugaaggccacccuccuggccgucuccgggguguacccgcugagcauccccgccacccucuucgugugguacuucuggcagaagaagaagcagcgcuccggcguccugugggacacccccagcccgcccgagguggagcgggccgugcuggacgacggcaucuaccgcaucaugcagcgggggcugcucggccgcucccaggucggggugggcguguuccaggagaacgucuuccacaccauguggcacgugacccgcggggccgugcugauguaccagggcaagcgccuggagcccagcugggccuccgucaagaaggaccucaucagcuacggcgggggcuggcggcugcgcggguccuggaacacgggcgaggagguccaggugaucgccgucgagcccgggaagaaccccaagaacgugcagaccgcccccggcaccuucaagacccccgagggcgaggugggggccaucgcgcuggacuucaagcccggcacgagcgggucccccaucgucaaccgggagggcaagaucgugggccucuacgggaacggcguggucaccaccagcgggaccuacgugagcgccaucgcccaggccaaggcgucccaggagggcccgcugcccgagaucgaggacgagguguuccgcaagcggaaccugacgaucauggaccuccaccccgggagcggcaagacccgccgguaccugccggccaucguccgcgaggccaucaagcgcaagcugcggacccucauccuggcccccacccgcgugguggccuccgagauggcggaggcccugaagggcaugcccauccgguaccagacgaccgccgucaagagcgagcacaccgggaaggagaucguggaccucaugugccacgccaccuucacgaugcgccugcugucccccgugcgggucccgaacuacaacaugaucaucauggacgaggcccacuucaccgaccccagcuccaucgcggcccgcggcuacaucagcacccggguggggaugggcgaggccgccgccaucuucaugaccgcgacgccgcccggguccguggaggccuucccgcagagcaacgccgucauccaggacgaggagcgcgacauccccgagcgguccuggaacagcggcuacgaguggaucaccgacuuccccggcaagaccgugugguucgugcccuccaucaagagcgggaacgacaucgccaacugccuccgcaagaacggcaagcgggucauccagcugucccgcaagaccuucgacacggaguaccagaagaccaagaacaacgacugggacuacguggugaccaccgacaucagcgagaugggggcgaacuuccgggccgaccgcgucaucgacccgcggcgcugccugaagcccgugauccucaaggacggccccgagcgggugauccuggccgggcccaugccggucacgguggccuccgccgcgcagcgccggggccgcaucggccgcaaccacaacaaggagggggaccaguacaucuacaugggccagccccugaacaacgacgaggaccacgcccacuggaccgaggccaagaugcuccuggacaacaucaacacccccgaggggaucauccccgcccuguucgagccggagcgggagaaguccgccgcggucgacggcgaguaccgccuccgcggggaggcccgcaagaccuucguggagcugaugcggcgcggcgaccugcccguguggcucuccuacaaggucgccagcgagggcuuccaguacagcgaccggcgcuggugcuucgacggggagcggaacaaccaggugcuggaggagaacauggacguggagaucuggacgaaggagggcgagcgcaagaagcugcggccccgcuggcucgacgcccggaccuacuccgacccccuggcccugcgcgaguucaaggaguucgcggccgggcggcgcagcgucuccggcgaccucauccuggagaucggcaagcugccgcagcaccucacccagcgggcccagaacgcccuggacaaccuggugaugcuccacaacagcgagcagggcgggcgcgcguaccggcacgccauggaggagcugcccgacaccaucgagacgcugaugcuccuggcccugaucgccgugcucaccgggggcgucacccuguucuuccuguccgggcgcggccucggcaagaccagcaucgggcugcugugcgugauggccuccagcgugcuccuguggauggcguccgucgagccccacuggaucgccgccagcaucauccuggaguucuuccucauggugcugcugauccccgagccggaccggcagcgcacgccccaggacaaccagcucgccuacguggucaucggccugcuguucaugauccucacgguggccgcgaacgagauggggcugcuggagaccaccaagaaggaccucggcaucgggcacguggccgucgagaaccaccaccacgccgccaugcuggacguggaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggucccccugcuggcccucggcugcuacagccaggugaacccccugacccugacggcggccgugcucaugcuggucgcccacuacgccaucaucgggccgggccugcaggccaaggcgacccgggaggcccagaagcgcaccgccgccgggaucaugaagaaccccaccguggacggcaucguggccaucgaccucgaccccgucguguacgacgcgaaguucgagaagcagcugggccagaucaugcugcucauccugugcacgucccagauccugcucaugcggaccaccugggcccugugcgagagcaucacccuggccacggggccccucaccacccugugggagggcuccccggggaaguucuggaacaccacgaucgccgugagcauggccaacaucuuccgcggcuccuaccuggcgggcgccgggcucgccuucagccugaugaagucccugggcgggggccggcgcgggaccggcgcccagggcgagacccucggggagaaguggaagcggcagcugaaccagcuguccaagagcgaguucaacaccuacaagcgcuccggcaucauggaggucgaccggagcgaggcgaaggaggggcucaagcgcggcgagacgaccaagcacgccgugucccgggggaccgccaagcugcgcugguucguggagcggaaccuggucaagcccgagggcaaggugaucgaccugggcugcgggcgcggcggguggagcuacuacugcgccggccucaagaaggugaccgaggucaagggguacacgaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgaccaucgaggaggggcggacgcugcgcguccucaagaugguggagcccuggcugcggggcaaccaguucugcaucaagauccugaaccccuacaugcccagcguggucgagacccucgagcagaugcagcgcaagcacggcgggaugcuggugcggaacccgcugucccgcaacagcacccacgagauguacuggguguccugcggcaccgggaacaucgucagcgcggugaacaugaccucccgcaugcuccugaaccgguucacgauggcccaccgcaagcccaccuacgagcgggacguggaccugggcaccggcacccgccacgucgccguggagcccgagguggccaaccucgacaucaucgggcagcggaucgagaacaucaagcacgagcacaagagcacguggcacuacgacgaggacaaccccuacaagaccugggccuaccacggcuccuacgaggucaagccgagcggguccgcgagcagcauggugaacggcgucgugaagcugcugaccaagcccugggacgugauccccauggucacccagaucgccaugacggacaccacccccuucgggcagcagcgcguguucaaggagaagguggacacccggacgccgaaggccaagcgcggcaccgcccagaucauggaggucaccgcccgguggcucuggggcuuccugucccgcaacaagaagccccggaucugcacccgcgaggaguucacgcggaaggugcgcagcaacgcggccaucggggccguguucgucgacgagaaccaguggaacuccgccaaggaggcgguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagauccccggcggcaacauguacgccgacgacaccgccgggugggacacccgcaucacggaggacgaccuccagaacgaggccaagaucaccgacaucauggagccggagcacgcccugcuggcgaaggccaucuucaagcucaccuaccagaacaaggugguccgggugcagcgccccgccaagaacggcaccgugauggacgucaucucccggcgcgaccagcgggggagcggccaggugggcacguacgggcugaacaccuucaccaacauggaggcccagcugauccgccagauggaguccgagggcaucuucagccccuccgagcucgagacccccaaccuggccgagcgggcgcuggacuggcucgagaaguacgggguggagcgccugaagcggauggccaucagcggcgacgacugcgucgugaagccgaucgacgaccgcuucgccacggcccugaccgcccucaacgacauggggaaggugcggaaggacaucccccagugggagcccuccaagggcuggaacgacuggcagcagguccccuucugcagccaccacuuccaccagcugaucaugaaggacggccgcgagaucguggugccgugccggaaccaggacgagcuggucgggcgcgcgcgggugucccagggcgccggguggagccuccgcgagaccgccugccugggcaagagcuacgcccagauguggcagcugauguacuuccaccggcgcgaccuccggcuggcggccaacgccaucugcuccgccgugcccgucgacugggugcccaccagccgcacgaccugguccauccacgcccaccaccaguggaugaccaccgaggacaugcugagcguguggaaccgcgucuggaucgaggagaaccccuggauggaggacaagacgcacaucuccagcugggaggacgugccguaccucgggaagcgggaggaccaguggugcggcucccugaucggccugaccgcgcgcgccaccugggccaccaacauccagguggccaucaaccagguccggcgccucaucgggaacgagaacuaccuggacuacaugaccagcaugaagcgguucaagaacgaguccgaccccgagggcgcccugugguga

SEQ ID NO: 8281 - RNA, 9879 nt, Artificial Sequence
  derived and/or modified CDS sequence (opt1) from DENV-1__EU660391__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcauccgguccgccacccgccuggagaacaucauguggaagcagaucagcaacgagcugaaccacauccuccuggagaacgacaugaaguucaccgugguggucggggacguggcgggcauccuggcccaggggaagaagaugauccggccccagcccauggaguacaaguacuccuggaaguccuggggcaaggccaagaucaucggcgccgacgugcagaacaccacguucaucaucgacgggcccaacaccccggagugccccgacgaccagcgcgcguggaacaucugggaggucgaggacuacggcuucgggaucuucaccaccaacaucuggcucaagcugcgggacuccuacacccaggugugcgaccaccgccugaugagcgccgccaucaaggacuccaaggccgugcacgccgacaugggcuacuggaucgagagcgagaagaacgagaccuggaagcucgcgcgggccuccuucaucgaggucaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccguggucguggacgagcacugcggcaaccgggggccgagccugcgcacgaccaccgugaccggcaagaucauccacgaguggugcugccgguccugcacgcugccgccccugcgcuucaagggggaggacggcugcugguacgggauggagauccggcccgucaaggagaaggaggagaaccuggucaagagcauggugagcgccggcuccggcgaggucgacagcuucucccuggggcuccugugcaucagcaucaugaucgaggaggugaugcgcucccgguggagccgcaagaugcugaugaccggcacccucgccguguucuuccugcugaucauggggcagcucaccuggaacgaccugauccggcugugcaucauggucggcgcgaacgccuccgaccgcauggggaugggcacgaccuaccucgcccugauggccaccuucaagaugcgcccgauguucgccgugggccuccuguuccggcgccugaccagccgggaggugcugcuccugacgaucgggcugucccucgucgcgagcguggagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgaugguccuguccaucgugagccuguucccccucugccuguccaccacgagccagaagaccaccuggcugcccgugcuccugggcucccuggggugcaagccgcucaccauguuccugaucgccgagaacaagaucuggggccgcaagagcuggccccugaacgaggggaucauggccgucggcaucgugagcauccuccuguccagccugcucaagaacgacgugccccuggccgggccccugaucgccggcggcaugcucaucgcgugcuacgucaucuccgggagcuccgccgaccugagccuggagaaggccgccgagguguccugggaggaggaggccgagcacagcggcgcgucccacaacauccucguggagguccaggacgacgggacgaugaagaucaaggacgaggagcgggacgacacccugaccauccugcucaaggccacccugcuggccgugagcggcguguacccgcucuccauccccgccacccuguucgucugguacuucuggcagaagaagaagcagcgcagcggggugcugugggacacgcccagcccgcccgagguggagcgggccguccucgacgacggcaucuaccgcaucaugcagcggggccugcuggggcgcagccaggugggcgugggggucuuccaggagaacguguuccacaccauguggcacgugacccggggcgcgguccugauguaccaggggaagcgccucgagcccuccugggccagcgugaagaaggaccugaucuccuacggcggcggguggcggcugcagggcagcuggaacaccggggaggaggugcaggucaucgccguggagcccggcaagaaccccaagaacgugcagacggcccccgggaccuucaagaccuccgagggcgaggucggcgccaucgcgcucgacuucaagcccgggaccagcggcagccccaucgugaaccgcgaggggaagaucgugggccuguacggcaacggggucgugacgaccuccggcaccuacgugagcgccaucgcccaggccaaggcgucccaggacgggccccugccggagaucgaggacgaggucuuccggaagcgcaaccucaccaucauggaccugcaccccggcagcgggaagacgcggcgcuaccugcccgccaucgugcgggaggccaucaagcgcaagcuccggacccugauccuggccccgacccgcguggucgccuccgagauggcggaggcccucaagggcaugcccauccgcuaccagaccacggccgucaagagcgagcacaccggcaaggagaucguggaccugaugugccacgccaccuucaccaugcggcugcucucccccguccgcgugcccaacuacaacaugaucaucauggacgaggcccacuucacggacccgagcuccaucgcggcccggggguacaucagcacccgcgugggcaugggggaggccgccgccaucuucaugaccgcgacgccgcccggcuccgucgaggccuucccccagagcaacgccgugauccaggacgaggagcgggacaucccggagcgcuccuggaacagcggguacgaguggaucacggacuuccccggcaagaccgugugguucguccccuccaucaagagcggcaacgacaucgccaacugccugcggaagaacgggaagcgcgugauccagcugucccggaagaccuucgacaccgaguaccagaagacgaagaacaacgacugggacuacguggucaccaccgacaucagcgagaugggcgcgaacuuccgcgccgaccgggugaucgacccccgccggugccucaagccggugauccugaaggacgggcccgagcgcgucauccuggccggccccaugcccgugaccgucgccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccgguguggcugagcuacaaggucgccuccgagggcuuccaguacagcgaccgccgguggugcuucgacggcgagcgcaacaaccaggugcuggaggagaacauggacguggagaucuggaccaaggagggggagcggaagaagcuccgcccccgguggcuggacgcccgcacguacuccgacccccuggcccuccgggaguucaaggaguucgcggccggccgccggagcgucuccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccgugcugacgggcggggucacccuguucuuccucuccggccgggggcugggcaagaccagcaucggccugcucugcgugauggccuccagcgugcugcuguggauggcguccgucgagccccacuggaucgccgccagcaucauccucgaguucuuccugauggugcugcucauccccgagcccgaccgccagcggaccccgcaggacaaccagcuggccuacguggucaucgggcuccucuucaugauccugaccguggccgcgaacgagaugggccugcucgagacgaccaagaaggaccuggggaucggccacguggccgucgagaaccaccaccacgccgccaugcuggacguggaccuccaccccgccuccgcguggacccuguacgccguggccaccacgaucaucacccccaugaugcgccacaccaucgagaacaccacggccaacaucagccugaccgccaucgcgaaccaggccgccauccucauggggcuggacaagggcuggccgaucuccaagauggacaucggcgucccccugcucgcccuggggugcuacagccaggugaacccccugacccucaccgcggccgugcugaugcuggucgcccacuacgccaucaucggccccgggcuccaggccaaggcgacgcgggaggcccagaagcgcaccgccgccggcaucaugaagaacccgaccguggacgggaucguggccaucgaccuggaccccgucguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgugagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagaccacgaagcacgccgugucccgcggcaccgccaagcugcggugguucguggagcgcaaccucgucaagccggaggggaaggugaucgaccugggcugcggccgcggcggguggagcuacuacugcgccgggcugaagaaggugaccgaggucaagggguacaccaagggcgggcccggccacgaggagcccauccccauggccacguacggguggaaccuggugaagcuccacuccggcaaggacguguucuucaucccgcccgagaagugcgacacccugcugugcgacaucggggagagcucccccaaccccaccaucgaggagggccgcacccuccggguccugaagaugguggagccguggcugcgcgggaaccaguucugcaucaagauccucaaccccuacaugcccagcguggucgagacgcuggagcagaugcagcggaagcacggcggcaugcuggugcgcaacccccucucccggaacagcacccacgagauguacuggguguccugcgggaccggcaacaucgucagcgcggugaacaugaccucccgcaugcugcugaaccgguucaccauggcccaccgcaagccgacguacgagcgcgacguggaccucggggccggcacccggcacgucgccguggagcccgagguggccaaccuggacaucaucggccagcgcaucgagaacaucaaguacgagcacaagagcaccuggcacuacgacgaggacaaccccuacaagaccugggcguaccacggguccuacgaggucaagcccagcggcagcgccuccagcauggugaacggggucgugaagcugcucacgaagccgugggacgugauccccauggucacccagaucgccaugaccgacaccacgcccuucggccagcagcggguguucaaggagaagguggacacccgcacccccaaggccaagcgggggaccgcccagaucauggaggucacggcgaaguggcuguggggcuuccugucccgcaacaagaagccgcggaucugcacccgcgaggaguucacccggaaggugcgcagcaacgccgccaucggcgccguguucgucgacgagaaccaguggaacuccgcgaaggaggccguggaggacgagcgguucugggaccucgugcaccgcgagcgggagcugcacaagcaggggaagugcgcgaccugcgucuacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggugguccgcgugcagcggccggccaagaacgggaccgugauggacgucaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccgggugcucgacuggcuggagaagcacggggucgagcgccugaagcggauggcgaucuccggcgacgacugcguggugaagcccaucgacgaccgcuucgccaccgcccucaccgcccugaacgacauggggaagguccggaaggacaucccgcagugggagcccagcaagggcuggaacgacuggcagcagguccccuucugcagccaccacuuccaccagcugaucaugaaggacggccgcgagaucgugguccccugccggaaccaggacgagcucguggggcgcgcccgggugucccagggcgcgggguggagccugcgcgagacggccugccugggcaaguccuacgcccagauguggcagcucauguacuuccaccggcgcgaccugcggcuggccgcgaacgccaucugcagcgccgucccgguggacugggugcccaccucccgcaccaccuggagcauccacgcccaccaccaguggaugacgaccgaggacaugcucuccgucuggaaccggguguggaucgaggagaaccccuggauggaggacaagacccacaucagcuccugggaggacgugcccuaccuggggaagcgcgaggaccaguggugcggcagccugaucggccucaccgcccgggcgacgugggccaccaacauccaggucgccaucaaccaggugcgccgccugaucgggaacgagaacuaccuggacuacaugaccuccaugaagcgguucaagaacgagagcgacccggagggcgcccucugguga

SEQ ID NO: 8282 - RNA, 9879 nt, Artificial Sequence
  derived and/or modified CDS sequence (opt1) from DENV-1__EU660393__SS-prME
agcgugaccaugcugcugaugcugaugcccaccgcccuggccuuccaccucaccacccggggcggggagccccacaugaucguguccaagcaggagcggggcaagagccugcuguucaagaccuccgccggggugaacaugugcacccucaucgccauggaccugggcgagcugugcgaggacaccaugaccuacaagugcccccggaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaaggggaucacccaguccggccggcugaucaccgccaacccgaucgugaccgacaaggagaagcccgugaacaucgaggccgagccgcccuucggggagagcuacaucaucaucggcgccggcgagaaggcgcugaagcucuccugguucaagaaggggagcuccaucggcaagauguucgaggccacggcccgcggggcccggcgcauggccauccugggcgacaccgcgugggacuucgggagcaucggcggcgucuucaccuccguggggaagcuggugcaccagaucuucggcaccgccuacgggguccucuucagcggcguguccuggacgaugaagaucgggaucggcgugcugcugaccuggcucggccugaacagccgcuccaccagccuguccaugaccugcaucgccgucgggcucgugacgcuguaccugggcgugaugguccaggccgacagcgggugcgugaucaacuggaagggccgggagcucaagugcgggagcggcaucuucgugaccaacgagguccacaccuggaccgagcaguacaaguuccaggccgacuccccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucacgguggucgugggggacguggccggcauccucgcgcaggggaagaagaugauccggccccagcccauggaguacaaguacuccuggaaguccuggggcaaggccaagaucaucggcgccgacguccagaacaccaccuucaucaucgacgggcccaacaccccggagugccccgacgaccagcgcgccuggaacaucugggagguggaggacuacggcuucgggaucuucacgaccaacaucuggcugaagcugcgggacuccuacacccaggugugcgaccaccgccucaugagcgcggccaucaaggacuccaaggccguccacgccgacaugggcuacuggaucgagagcgagaagaacgagaccuggaagcuggcccgggcguccuucaucgaggugaagacgugcaucuggcccaagagccacacccugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcacgaccgucgugguggacgagcacugcggcaaccgggggccgagccugcgcaccaccacggucaccggcaagaucauccacgaguggugcugccgguccugcacccugccgccccuccgcuuccgcggggaggacggcugcugguacgggauggagauccgccccgugaaggagaaggaggagaaccuggucaagagcauggucagcgccggcuccggcgagguggacagcuucucccucgggcugcugugcaucagcaucaugaucgaggaggugaugcggucccgcuggagccggaagaugcucaugaccggcacgcuggccgucuucuuccugcucaucauggggcagcugaccuggaacgaccugauccgccucugcaucauggugggcgccaacgcguccgaccgcauggggaugggcaccaccuaccuggcccugauggccacguucaagaugcggccgauguucgccgugggccuccuguuccgccggcugaccagccgcgagguccuccugcugaccaucgggcucucccugguggccagcguggagcugcccaacucccucgaggagcugggcgacgggcuggcgaugggcaucaugauccucaagcugcugaccgacuuccagagccaccagcucugggccacgcugcugucccucaccuucaucaagaccaccuucagccugcacuacgccuggaagacgauggccaugguccuguccaucgugagccucuucccccugugccuguccaccaccagccagaagaccacguggcuccccguccugcugggcucccucgggugcaagccgcugaccauguuccugaucgcggagaacaagaucuggggccggcgcagcuggccccucaacgaggggaucauggccgugggcaucgugagcauccugcuguccagccuccugaagaacgacgucccccuggccgggccccucaucgccggcggcaugcugaucgccugcuacgugaucuccgggagcuccgcggaccugagccucgagaaggccgccgagguguccugggaggaggaggccgagcacagcggcgccucccacaacauccuggucgaggugcaggacgacgggaccaugaagaucaaggacgaggagcgggacgacacccugaccauccuccugaaggcgacgcugcucgccgugagcggcgucuacccgcuguccauccccgccacccuguucgugugguacuucuggcagaagaagaagcagcgcagcggggugcucugggacacccccagcccgcccgaggucgagcgggccgugcuggacgacggcaucuaccgcaucaugcagcggggccugcuggggcgcagccaggugggcgucgggguguuccaggagaacguguuccacaccauguggcacgucacgcggggcgccgugcucauguaccaggggaagcgccuggagcccuccugggcgagcgugaagaaggaccugaucuccuacggcggcggguggcggcuccagggcagcuggaacaccggggaggagguccaggugaucgccguggagcccggcaagaaccccaagaacguccagaccgcccccgggaccuucaagacgcccgagggcgaggugggcgccaucgcccuggacuucaagcccgggaccuccggcagccccaucgugaaccgcgaggggaagaucgucggccuguacggcaacgggguggugaccaccagcggcacguacgucuccgcgaucgcccaggccaaggccagccaggaggggccgcuccccgagaucgaggacgagguguuccggaagcgcaaccugaccaucauggaccugcaccccggcuccgggaagacccggcgcuaccucccggcgaucgugcgggaggccaucaagcgcaagcugcgcacccugauccucgcccccacgcgggucguggccagcgagauggccgaggcgcugaagggcaugcccauccgcuaccagaccaccgccgugaaguccgagcacaccggcaaggagaucgucgaccugaugugccacgccacguucaccaugcggcuccugagccccgugcgcgugccgaacuacaacaugaucaucauggacgaggcccacuucaccgaccccuccagcaucgccgcgcggggguacaucuccacccgcgucggcaugggggaggccgccgccaucuucaugacggccacgccgcccggcagcguggaggcguucccgcaguccaacgccgugauccaggacgaggagcgggacauccccgagcgcagcuggaacuccggguacgaguggaucaccgacuuccccggcaagaccgucugguucgugcccagcaucaaguccggcaacgacaucgccaacugccugcggaagaacgggaagcgcgugauccagcucagccggaagacguucgacaccgaguaccagaagaccaagaacaacgacugggacuacgucgugaccacggacaucuccgagaugggcgccaacuuccgcgcggaccgggugaucgacccgcgccggugccugaagcccgucauccugaaggacgggcccgagcgcgugauccucgccggccccaugccggugaccgucgccagcgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucguggagcucaugcgccgcggggaccugcccgucuggcugagcuacaagguggccagcgagggcuuccaguacuccgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccccucgcccugcgggaguucaaggaguucgccgcgggccgccgguccgugagcggggaccugauccucgagaucggcaagcugccgcagcaccugacccagcgcgcccagaacgcccucgacaaccuggugaugcugcacaacuccgagcagggcgggcgggccuaccgccacgcgauggaggagcuccccgacacgaucgagacccugaugcugcucgcccugaucgccguccugaccggcggggugacccucuucuuccugagcggccgggggcugggcaagaccuccaucggccuccugugcgugauggccagcuccguccugcucuggauggccagcguggagccccacuggaucgcggccuccaucauccuggaguucuuccugauggugcuccugauccccgagccggaccgccagcggacgccccaggacaaccagcuggccuacgucgugaucgggcuccuguucaugauccugaccguggccgccaacgagaugggccuccuggagaccaccaagaaggaccuggggaucggccacgucgcgguggagaaccaccaccacgccgccaugcucgacguggaccugcaccccgccagcgccuggacgcuguacgcggucgccaccaccaucaucaccccgaugaugcgccacacgaucgagaacaccaccgccaacaucucccucaccgccaucgccaaccaggcggccauccugauggggcuggacaagggcuggcccaucagcaagauggacaucggcgugccccuccuggcccuggggugcuacucccaggugaacccccucacgcugaccgccgcgguccugaugcucguggcccacuacgccaucaucggcccggggcugcaggccaaggccacccgcgaggcgcagaagcggaccgccgccggcaucaugaagaaccccacgguggacgggaucgucgccaucgaccuggaccccgugguguacgacgccaaguucgagaagcagcucggccagaucaugcugcugauccucugcaccagccagauccugcugaugcgcaccaccugggcgcucugcgaguccaucacgcuggccaccggcccccugaccacccucugggaggggagcccgggcaaguucuggaacacgaccaucgccgucuccauggccaacaucuuccgggggagcuaccuggccggcgcgggccuggccuucagccucaugaagucccucgggggcgggcgccgggggaccggggcccagggcgagacccugggcgagaaguggaagcgccagcucaaccagcugagcaaguccgaguucaacacguaccggcgcagcgggaucauggagguggaccgguccgaggccaaggagggccugaagcgcggggagaccaccaagcacgcggugagccggggcaccgccaagcuccgcugguucgucgagcggaaccuggugaagcccgaggggaaggugaucgaccugggcugcggccgcgggggcugguccuacuacugcgccgggcugaagaaggucacggaggugaagggcuacaccaagggcgggcccggccacgaggagcccaucccgauggccaccuacggguggaaccucgugaagcugcacagcggcaaggacgucuucuucaucccgcccgagaagugcgacacccugcucugcgacaucggggaguccagccccaacccgacgaucgaggagggccggacccugcgcgugcugaagaugguggagcccuggcuccgggggaaccaguucugcaucaagauccugaaccccuacaugcccuccgucguggagacccuggagcagaugcagcgcaagcacggcggcaugcucgugcggaacccgcugagccgcaacuccacccacgagauguacugggucagcugcgggaccggcaacaucguguccgccgugaacaugacgagccgcaugcugcucaaccgguucaccauggcgcaccgcaagcccaccuacgagcgggacgucgaccugggggccggcacccgccacguggccguggagcccgaggucgccaaccuggacaucaucggccagcggaucgagaacaucaagcacgagcacaaguccacguggcacuacgacgaggacaaccccuacaagaccugggccuaccacgggagcuacgaggugaagccguccggcagcgcgagcuccauggugaacggggucgugaagcuccugaccaagcccugggacgucauccccauggugacccagaucgccaugacggacaccacccccuucggccagcagcgcguguucaaggagaaggucgacacccggacgccgaaggccaagcgcgggaccgcccagaucauggaggugaccgccaaguggcuguggggcuuccucagccggaacaagaagccccgcaucugcacccgggaggaguucacgcgcaaggugcgguccaacgcggccaucggcgccgucuucguggacgagaaccaguggaacagcgccaaggaggcgguggaggacgagcgcuucugggaccugguccaccgggagcgcgagcugcacaagcaggggaagugcgcgaccugcguguacaacaugaugggcaagcgggagaagaagcucggggaguucggcaaggccaaggggucccgcgccaucugguacauguggcugggcgcccgguuccuggaguucgaggcgcucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacccgcaucacggaggacgaccugcagaacgaggcccgcaucaccgacaucauggagccggagcacgcccuccuggccaagagcaucuucaagcugaccuaccagaacaaggucgugcgggugcagcgccccgccaagaacgggaccgucauggacgugaucucccggcgcgaccagcggggcagcggccagguggggacguacggccucaacaccuucaccaacauggaggcccagcugauccgccagauggaguccgaggggaucuucagccccuccgagcuggagacccccaaccucgccgagcggguccuggacuggcuggagaaguacggcguggagcgccucaagcggauggccaucagcggggacgacugcguggucaagccgaucgacgaccgcuucgcgacggcccugaccgcccugaacgacaugggcaaggugcggaaggacaucccccagugggagcccuccaagggguggaacgacuggcagcagguccccuucugcagccaccacuuccaccagcucaucaugaaggacggccgcgagaucgucgugccgugccggaaccaggacgagcuggugggccgcgcccgggucagccagggggccggcuggucccugcgcgagaccgcgugccucggcaagagcuacgcccagauguggcagcugauguacuuccaccggcgcgaccugcggcucgccgccaacgcgaucugcuccgccgugcccguggacuggauccccaccagccgcacgaccugguccauccacgcccaccaccaguggaugaccaccgaggacaugcugagcgucuggaaccgcguguggaucgaggagaaccccuggauggaggacaagacgcacaucuccagcuggggcgacgugccguaccuggggaagcgggaggaccaguggugcggcucccucaucggccugaccgcccgcgccaccugggcgaccaacauccaggucgccaucaaccaggugcggcgccugaucgggaacgagaacuaccucgacuacaugaccagcaugaagcgguucaagaacgaguccgaccccgagggcgcccugugguga

SEQ ID NO: 8283 - RNA, 9879 nt, Artificial Sequence
  derived and/or modified CDS sequence (opt1) from DENV-1__EU660401__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgagaccgagcccgacgacguggacugcuggugcaacgccacggacaccugggucaccuacgggaccugcagccagacgggcgagcaccggcgggacaagcgguccguggcccucgcgccccacgugggccuggggcuggagacccgcaccgagaccuggaugagcuccgagggcgccuggaagcagauccagcgggucgagacgugggcccuccggcaccccggguucaccgugaucgcccuguuccuggcccacgcgaucggcaccagcaucacccagaaggggaucaucuucauccuccugaugcuggugacgcccuccauggccaugcggugcgucggcaucggcagccgcgacuucguggaggggcucuccggcgccaccuggguggacgucgugcuggagcacgggagcugcgugaccaccauggccaaggacaagcccacgcuggacaucgagcuccugaagaccgaggucaccaaccccgccgugcugcggaagcucugcaucgaggcgaagaucuccaacaccacgaccgacagccgcugcccgacccagggcgaggccacccugguggaggagcaggacgccaacuucgucugccggcgcacguucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacacgggcgaccagcaccagguggggaacgaguccaccgagcacggcaccaccgccaccaucacgccccaggcgcccaccaccgagauccagcucaccgacuacggggcccugacgcuggacugcagcccccgcaccggccucgacuucaacgagaugguccugcugaccaugaaggagaaguccuggcucgugcacaagcagugguuccuggaccugccccuccccuggaccagcggggccagcacgucccaggagaccuggaaccggcaggaccugcuggugaccuucaagaccgcccacgccaagaagcaggaggucguggugcucggcagccaggagggcgcgaugcacacggcccugaccggggccaccgagauccagaccuccggcacgaccaccaucuucgccgggcaccugaagugccgccucaagauggacaagcugacccugaagggcaugagcuacgucaugugcacgggguccuucaagcucgagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucaucaucggcgccggcgagaaggcgcugaagcucagcugguucaagaagggguccagcaucggcaagauguucgaggccacggcccgcggggcccggcgcauggccauccugggcgacaccgcgugggacuucggguccaucggcggcguguucaccagcguggggaagcugguccaccagaucuucggcaccgccuacggggugcuguucuccggcgugagcuggacgaugaagaucgggaucggcguccugcugaccuggcucggccugaacucccgcagcaccucccugagcaugaccugcaucgccguggggcucgugacgcuguaccugggcgucauggugcaggccgacuccgggugcgugaucaacuggaagggccgggagcucaagugcgggagcggcaucuucgucaccaacgaggugcacaccuggaccgagcaguacaaguuccaggccgacagcccgaagcgccuguccgcggccaucggcaaggccugggaggagggggugugcggcauccggagcgccacccgccuggagaacaucauguggaagcagaucuccaacgagcucaaccacauccugcuggagaacgacaugaaguucacggucguggugggggacgucgccggcauccucgcgcaggggaagaagaugauccggccccagcccauggaguacaaguacagcuggaaguccuggggcaaggccaagaucaucggcgccgacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacagccacacccaggucugcgaccaccgccucauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacgcuggccguguucuuccugcucaucauggggcagcugaccuggaacgaccugauccgccucugcaucauggugggcgccaacgcgagcgaccgcauggggaugggcaccaccuaccuggcccugauggccacguucaagaugcggccgauguucgccgucggccuccuguuccgccggcugaccucccgcgaggugcuccugcugaccaucgggcucagccugguggccuccgucgagcugcccaacagccucgaggagcugggcgacgggcuggcgaugggcaucaugauccucaagcugcugaccgacuuccagucccaccagcucugggccacgcugcugagccucaccuucaucaagaccaccuucucccugcacuacgccuggaagacgauggccauggugcugagcaucgucucccucuucccccugugccugagcaccaccucccagaagaccacguggcuccccgugcugcugggcagccucgggugcaagccgcugaccauguuccugaucgcggagaacaagaucuggggccggcgcuccuggccccucaacgaggggaucauggccgugggcaucgucagcauccugcugagcucccuccugaagaacgacgugccccuggccgggccccucaucgccggcggcaugcugaucgccugcuacgugaucagcggguccagcgcggaccugucccucgagaaggccgccgaggucagcugggaggaggaggccgagcacuccggcgccagccacaacauccugguggaggugcaggacgacgggaccaugaagaucaaggacgaggagcgggacgacacccugaccauccuccugaaggcgacgcugcucgccgucuccggcguguacccgcugagcauccccgccacccuguucgugugguacuucuggcagaagaagaagcagcgcuccgggguccucugggacacccccagcccgcccgagguggagcgggccgugcuggacgacggcaucuaccgcaucaugcagcggggccugcuggggcgcucccaggucggcguggggguguuccaggagaacgucuuccacaccauguggcacgugacgcggggcgccgugcucauguaccaggggaagcgccuggagcccagcugggcguccgucaagaaggaccugaucagcuacggcggcggguggcggcuccagggcuccuggaacaccggggaggagguccaggugaucgccgucgagcccggcaagaaccccaagaacgugcagaccgcccccgggaccuucaagacgcccgagggcgaggugggcgccaucgcccuggacuucaagcccgggaccagcggcucccccaucgucaaccgcgaggggaagaucgugggccuguacggcaacgggguggucaccaccagcggcacguacgugagcgcgaucgcccaggccaaggccucccaggaggggccgcuccccgagaucgaggacgagguguuccggaagcgcaaccugaccaucauggaccugcaccccggcagcgggaagacccggcgcuaccucccggcgaucguccgggaggccaucaagcgcaagcugcgcacccugauccucgcccccacgcgggugguggccuccgagauggccgaggcgcugaagggcaugcccauccgcuaccagaccaccgccgucaagagcgagcacaccggcaaggagaucguggaccugaugugccacgccacguucaccaugcggcuccugucccccgugcgcgucccgaacuacaacaugaucaucauggacgaggcccacuucaccgaccccagcuccaucgccgcgcggggguacaucagcacccgcgugggcaugggggaggccgccgccaucuucaugacggccacgccgcccggcuccguggaggcguucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccugcggaagaacgggaagcgcgucauccagcucucccggaagacguucgacaccgaguaccagaagaccaagaacaacgacugggacuacguggugaccacggacaucagcgagaugggcgccaacuuccgcgcggaccgggucaucgacccgcgccggugccugaagcccgugauccugaaggacgggcccgagcgcgugauccucgccggccccaugccggucaccguggccuccgccgcccagcggcgcgggcggaucggccgcaaccacaacaaggagggcgaccaguacaucuacauggggcagccccugaacaacgacgaggaccacgcgcacuggaccgaggccaagaugcugcucgacaacaucaacacccccgagggcaucauccccgcccuguucgagccggagcgcgagaaguccgccgccaucgacggggaguaccggcugcgcggcgaggcgcggaagacguucgucgagcucaugcgccgcggggaccugcccguguggcuguccuacaagguggccagcgagggcuuccaguacagcgaccgccgguggugcuucgacggcgagcgcaacaaccagguccucgaggagaacauggacguggagaucuggaccaaggagggggagcggaagaagcugcgcccccgguggcuggacgcccgcaccuacuccgacccccucgcccugcgggaguucaaggaguucgccgcgggccgccggagcguguccggggaccugauccucgagaucggcaagcugccgcagcaccugacccagcgcgcccagaacgcccucgacaaccuggucaugcugcacaacagcgagcagggcgggcgggccuaccgccacgcgauggaggagcuccccgacacgaucgagacccugaugcugcucgcccugaucgccgugcugaccggcggggugacccucuucuuccuguccggccgggggcugggcaagaccagcaucggccuccugugcgucauggccuccagcgugcugcucuggauggccuccguggagccccacuggaucgcggccagcaucauccuggaguucuuccugaugguccuccugauccccgagccggaccgccagcggacgccccaggacaaccagcuggccuacguggugaucgggcuccuguucaugauccugaccgucgccgccaacgagaugggccuccuggagaccaccaagaaggaccuggggaucggccacguggcgguggagaaccaccaccacgccgccaugcucgacgucgaccugcaccccgccuccgccuggacgcuguacgcgguggccaccaccaucaucaccccgaugaugcgccacacgaucgagaacaccaccgccaacaucagccucaccgccaucgccaaccaggcggccauccugauggggcuggacaagggcuggcccaucuccaagauggacaucggcgugccccuccuggcccuggggugcuacagccaggucaacccccucacgcugaccgccgcggugcugaugcucguggcccacuacgccaucaucggcccggggcugcaggccaaggccacccgcgaggcgcagaagcggaccgccgccggcaucaugaagaaccccacggucgacgggaucguggccaucgaccuggaccccguggucuacgacgccaaguucgagaagcagcucggccagaucaugcugcugauccucugcaccucccagauccugcugaugcgcaccaccugggcgcucugcgagagcaucacgcuggccaccggcccccugaccacccucugggagggguccccgggcaaguucuggaacacgaccaucgccgugagcauggccaacaucuuccggggguccuaccuggccggcgcgggccuggccuucagccucaugaagucccucgggggcgggcgccgggggaccggggcccagggcgagacccugggcgagaaguggaagcgccagcucaaccagcuguccaagagcgaguucaacacguacaagcgguccgggaucauggagguggaccgcagcgaggccaaggagggccugaagcgcggggagaccaccaagcacgcggucucccgcggcaccgccaagcuccggugguucguggagcgcaaccuggugaagcccgaggggaaggucaucgaccugggcugcggccgcgggggcuggagcuacuacugcgccgggcugaagaaggugacggaggugaagggcuacaccaagggcggccccggccacgaggagcccaucccgauggccaccuacggguggaaccucgucaagcugcacuccggcaaggacguguucuucaucccgcccgagaagugcgacacccugcucugcgacaucggggagagcucccccaacccgacgaucgaggagggccgcacccugcgggugcugaagauggucgagcccuggcuccgcgggaaccaguucugcaucaagauccugaaccccuacaugcccagcgugguggagacccuggagcagaugcagcggaagcacggcggcaugcucguccgcaacccgcugucccggaacagcacccacgagauguacuggguguccugcgggaccggcaacaucgugagcgccgucaacaugacgucccgcaugcugcucaaccgcuucaccauggcgcaccggaagcccaccuacgagcgcgacguggaccugggggccggcacccggcacguggccgucgagcccgagguggccaaccuggacaucaucggccagcgcaucgagaacaucaagcacgagcacaagagcacguggcacuacgacgaggacaaccccuacaagaccugggccuaccacggguccuacgaggugaagccgagcggcuccgcgagcagcauggucaacgggguggucaagcuccugaccaagcccugggacgugauccccauggugacccagaucgccaugacggacaccacccccuucggccagcagcgggucuucaaggagaagguggacacccgcacgccgaaggccaagcgggggaccgcccagaucauggaggugaccgccaaguggcuguggggcuuccucucccgcaacaagaagccccggaucugcacccgcgaggaguucacgcggaagguccgcagcaacgcggccaucggcgccguguucguggacgagaaccaguggaacuccgccaaggaggcggucgaggacgagcgguucugggaccuggugcaccgcgagcgggagcugcacaagcaggggaagugcgcgaccugcguguacaacaugaugggcaagcgcgagaagaagcucggggaguucggcaaggccaaggggagccgggccaucugguacauguggcugggcgcccgcuuccuggaguucgaggcgcucggcuucaugaacgaggaccacugguucucccgggagaacagccuguccggggucgagggcgaggggcugcacaagcucggcuacauccugcgcgacaucagcaagauccccgggggcaacauguacgccgacgacaccgccggcugggacacccggaucacggaggacgaccugcagaacgaggcccgcaucaccgacaucauggagccggagcacgcccuccuggcgaaguccaucuucaagcugaccuaccagaacaagguggugcgcguccagcggcccgccaagaacgggaccgugauggacgugaucagccgccgggaccagcgcggcuccgggcaggucggcacguacggccucaacaccuucaccaacauggaggcccagcugauccggcagauggagagcgaggggaucuucucccccagcgagcuggagacccccaaccucgccgagcgcgugcuggacuggcuggagaaguacggcguggagcggcucaagcgcauggccaucuccggggacgacugcgucgugaagccgaucgacgaccgguucgcgacggcccugaccgcccugaacgacaugggcaaggugcgcaaggacaucccccagugggagcccagcaagggguggaacgacuggcagcagguccccuucugcucccaccacuuccaccagcucaucaugaaggacggccgggagaucguggugccgugccgcaaccaggacgagcuggucggccgggcccgcgugagccagggggccggcuggagccugcgggagaccgcgugccucgggaaguccuacgcccagauguggcagcugauguacuuccaccgccgggaccugcgccucgccgccaacgcgaucugcagcgccgugcccgucgacuggauccccaccucccggacgaccuggagcauccacgcccaccaccaguggaugaccaccgaggacaugcuguccguguggaaccgcguguggaucgaggagaaccccuggauggaggacaagacgcacaucagcuccuggggcgacgucccguaccuggggaagcgcgaggaccaguggugcggcagccucaucggccugaccgcccgggccaccugggcgaccaacauccagguggccaucaaccaggugcgccggcugaucgggaacgagaacuaccucgacuacaugaccuccaugaagcgcuucaagaacgagggcgaccccgagggggcccugugguga
